US009303252B2

(12) United States Patent
Amick et al.

(10) Patent No.: US 9,303,252 B2
(45) Date of Patent: Apr. 5, 2016

(54) MODIFIED VALENCENE SYNTHASE POLYPEPTIDES, ENCODING NUCLEIC ACID MOLECULES AND USES THEREOF

(75) Inventors: Jean Davin Amick, Lexington, KY (US); Grace Eunyoung Park, Lexington, KY (US); Bryan N. Julien, Lexington, KY (US); Richard P. Burlingame, Nicholasville, KY (US)

(73) Assignee: Evolva, Inc., Reinach (CH)

(*) Notice: Subject to any disclaimer, the term of this patent is extended or adjusted under 35 U.S.C. 154(b) by 738 days.

(21) Appl. No.: 13/317,839

(22) Filed: Oct. 28, 2011

(65) Prior Publication Data

US 2012/0246767 A1 Sep. 27, 2012

Related U.S. Application Data

(60) Provisional application No. 61/455,990, filed on Oct. 29, 2010, provisional application No. 61/573,745, filed on Sep. 9, 2011.

(51) Int. Cl.

| | |
|---|---|
| ***C07K 14/415*** | (2006.01) |
| ***C12N 15/81*** | (2006.01) |
| ***C12N 15/82*** | (2006.01) |
| ***C07H 21/04*** | (2006.01) |
| ***C12N 9/88*** | (2006.01) |
| ***C12N 15/86*** | (2006.01) |

(52) U.S. Cl.

CPC .................. *C12N 9/88* (2013.01); *C07H 21/04* (2013.01); *C07K 14/415* (2013.01); *C12N 15/81* (2013.01); *C12N 15/82* (2013.01); *C12N 15/86* (2013.01)

(58) Field of Classification Search

None

See application file for complete search history.

(56) References Cited

U.S. PATENT DOCUMENTS

| | | | | |
|---|---|---|---|---|
| 4,952,496 | A | 8/1990 | Studier et al. | 435/91 |
| 5,824,774 | A | 10/1998 | Chappell et al. | 530/350 |
| 5,847,226 | A | 12/1998 | Muller et al. | 568/346 |
| 6,072,045 | A | 6/2000 | Chappell et al. | 536/23.1 |
| 6,468,772 | B1 * | 10/2002 | Chappell et al. | 435/183 |
| 6,495,354 | B2 | 12/2002 | Chappell et al. | 435/183 |
| 6,531,303 | B1 | 3/2003 | Millis et al. | 435/155 |
| 6,559,297 | B2 | 5/2003 | Chappell et al. | 536/23.1 |
| 6,569,656 | B2 | 5/2003 | Chappell et al. | 435/183 |
| 6,645,762 | B2 | 11/2003 | Chappell et al. | 435/325 |
| 6,689,593 | B2 | 2/2004 | Millis et al. | 435/155 |
| 6,890,752 | B2 | 5/2005 | Chappell et al. | 435/325 |
| 7,273,735 | B2 * | 9/2007 | Schalk et al. | 435/166 |
| 7,442,785 | B2 | 10/2008 | Chappell et al. | 536/23.6 |
| 7,622,614 | B2 | 11/2009 | Julien et al. | 568/327 |
| 7,790,426 | B2 | 9/2010 | Schalk et al. | 435/167 |
| 8,124,811 | B2 | 2/2012 | Julien et al. | 568/367 |
| 8,354,504 | B2 | 1/2013 | Chappell et al. | 530/379 |
| 8,362,309 | B2 | 1/2013 | Julien et al. | 583/360 |
| 8,481,286 | B2 | 7/2013 | Julien et al. | 435/69.1 |
| 8,569,025 | B2 | 10/2013 | Zulak et al. | 435/157 |
| 8,753,842 | B2 | 6/2014 | Julien et al. | 435/166 |
| 2004/0249219 | A1 | 12/2004 | Saucy | 568/388 |
| 2005/0210549 | A1 | 9/2005 | Schalk et al. | 800/287 |
| 2006/0218661 | A1 * | 9/2006 | Chappell et al. | 800/278 |
| 2007/0141574 | A1 | 6/2007 | Keasling et al. | 435/6 |
| 2008/0213832 | A1 | 9/2008 | Schalk et al. | 435/69.1 |
| 2008/0233622 | A1 | 9/2008 | Julien et al. | 435/148 |
| 2009/0123984 | A1 | 5/2009 | Chappell et al. | 435/166 |
| 2010/0129306 | A1 | 5/2010 | Julien et al. | 424/65 |
| 2010/0151519 | A1 | 6/2010 | Julien et al. | 435/69.1 |
| 2010/0151555 | A1 | 6/2010 | Julien et al. | 435/193 |
| 2010/0216186 | A1 | 8/2010 | Chappell et al. | 435/69.1 |
| 2011/0281257 | A1 | 11/2011 | Schalk | 435/4 |
| 2012/0129235 | A1 | 5/2012 | Julien et al. | 435/166 |
| 2013/0071877 | A1 | 3/2013 | Chappell et al. | 435/41 |
| 2013/0122560 | A1 | 5/2013 | Julien et al. | 435/148 |
| 2013/0236943 | A1 | 9/2013 | Julien et al. | 435/166 |
| 2014/0242660 | A1 | 8/2014 | Chappell | 435/468 |

FOREIGN PATENT DOCUMENTS

| | | |
|---|---|---|
| EP | 1 083 233 | 8/2003 |
| EP | 2 363 458 | 9/2011 |
| WO | WO 00/17327 | 3/2000 |
| WO | WO 03/025193 | 3/2003 |
| WO | WO 2004/031376 | 4/2004 |
| WO | WO 2005/021705 | 3/2005 |
| WO | WO 2006/079020 | 7/2006 |
| WO | WO 2009/101126 | 8/2009 |
| WO | WO 2009/109597 | 9/2009 |
| WO | WO 2010/019696 | 2/2010 |
| WO | WO 2010/067309 | 6/2010 |
| WO | WO 2011/074954 | 6/2011 |
| WO | WO 2012/058636 | 5/2012 |

OTHER PUBLICATIONS

Sharon-Asa et al, 2003, Plant J., 36:664-674.*

Letter/Written Disclosure of the Supplemental Information Disclosure Statement for the above-referenced application, mailed on the same day herewith, 2 pages.

Response to Written Opinion, submitted Dec. 31, 2012, in connection with corresponding International Patent Application No. PCT/US2011/058456, 160 pages.

International Preliminary Report on Patentability, issued Feb. 5, 2013, in connection with corresponding International Patent Application No. PCT/US2011/058456, 17 pages.

Response to Communication, filed Dec. 30, 2013, in connection with corresponding European Patent Application No. 11779944.5, 36 pages.

(Continued)

*Primary Examiner* — David H Kruse

*Assistant Examiner* — Jason Deveau Rosen

(74) *Attorney, Agent, or Firm* — McDonnell Boehnen Hulbert & Berghoff LLP

(57) ABSTRACT

Provided are modified valencene synthase polypeptides and methods of using the modified valencene synthase polypeptides. Also provided are methods for producing modified terpene synthases.

62 Claims, 12 Drawing Sheets

(56) References Cited

OTHER PUBLICATIONS

Phys.org, "Substance that gives grapefruit its flavor and aroma could give insect pests the boot," found on Phys.org dated Sep. 11, 2013 [online][retrieved on Nov. 19, 2013] Retrieved from:<URL:http://phys.org/news/2013-09-substance-grapefruit-flavor-aroma-insect.html, 2 pages.
International Search Report and Written Opinion, issued Jan. 30, 2012, in connection with corresponding International Patent Application No. PCT/US2011/058456, 22 pages.
Allylix, "Protein engineering and chembiosynthesis to produce novel sesquiterpenoids," Presentation at BIO World Congress on Industrial Biotechnology & Bioprocessing, Washington, D.C. (Jun. 28, 2010), 19 pages.
Altschul et al., "Basic local alignment search tool," J. Molec. Biol. 215(3):403-410 (1990).
Altschul, S., "Amino acid substitution matrices from an information theoretic perspective," J. Mol. Biol. 219(3):555-565 (1991).
Arantes et al., "The preparation and microbiological hydroxylation of the sesquiterpenoid nootkatone," J. Chem. Res. (Synopsis) 3:248 (1999).
Back et al., "Cloning and bacterial expression of sesquiterpene cyclase, a key branch point enzyme for the synthesis of sesquiterpenoid phytoalexin capsidiol in UV-challenged leaves of *Capsicum annuum*," Plant Cell. Physiol. 39:899-904 (1998).
Back et al., "Cloning of a sesquiterpene cyclase and its functional expression by domain swapping strategy," Mol. Cells 10:220-225 (2000).
Back et al., "Expression of a plant sesquiterpene cyclase gene in *Escherichia coli*," Arch. Biochem. Biophys. 315:527-532 (1994).
Back, K. and J. Chappell, "Cloning and bacterial expression of a sesquiterpene cyclase from *Hyoscyamus muticus* and its molecular comparison to related terpene cyclases," J. Biol. Chem. 270:7375-7381 (1995).
Back, K. and J. Chappell, "Identifying functional domains within terpene cyclases using a domain-swapping strategy," Proc. Natl. Acad. Sci. U.S.A. 93:6841-6845 (1996).
Beier, D. and E. Young, "Characterization of a regulatory region upstream of the *ADR2* locus of *S. cerevisiae*," Nature 300:724-728 (1982).
Bohlmann et al., "Plant terpenoid synthases: molecular biology and phylogenetic analysis," Proc. Natl. Acad. Sci. U.S.A. 95:4126-4133 (1998).
Brodelius et al., "Fusion of farnesyldiphosphate synthase and epi-aristolochene synthase, a sesquiterpene cyclase involved in capsidiol biosynthesis in Nicotiana tabacum," Eur. J. Biochem. 269:3570-3577 (2002).
Brown et al., "Codon utilisation in the pathogenic yeast, Candida albicans," Nucleic Acids Res. 19(15):4298 (1991).
Burns, N., "The vetivane sesquiterpenes," The Baran Laboratory at Scripps Research Institute Group Meeting held on Dec. 15, 2004, 9 pages.
Calvert et al., "Germacrene A is a product of the aristolochene synthase-mediated conversion of farnesylpyrophosphate to aristolochene," J. Am. Chem. Soc. 124:11636-11641 (2002).
Cane et al., "Aristolochene biosynthesis and enzymatic cyclization of farnesyl pyrophosphate," J. Am. Chem. Soc. 111:8914-8916 (1989).
Cane, D., "Enzymatic formation of sesquiterpenes," Chem. Rev. 90:1089-1103 (1990).
Carillo, H. and D. Lipman, "The multiple sequence alignment problem in biology," SIAM J. Appl. Math. 48(5):1073-1082 (1988).
Chappell et al., "Is the reaction catalyzed by 3-hydroxy-3-methylglutaryl coenzyme A reductase a rate-limiting step for isoprenoid biosynthesis in plants," Plant Physiol. 109:1337-1343 (1995).
Chappell, J, "Biochemistry and molecular biology of the isoprenoid biosynthetic pathway in plants," Annu. Rev. Plant Physiol. Plant Mol. Biol. 46:521-547 (1995).
Chappell, J, "The genetics and molecular genetics of terpene and sterol origami," Curr. Opin. Plant Biol. 5:151-157 (2002).
Chappell, J., "The biochemistry and molecular biology of isoprenoid metabolism," Plant Physiol. 107:1-6 (1995).
Chappell, J., "Valencene synthase—a biochemical magician and harbinger of transgenic aromas," Trends Plant Sci. 9(6):266-269 (2004).
Christianson, "Unearthing the roots of the terpenome," Curr. Opin. Chem. Biol. 12(2):141-150 (2008).
de Boer et al., "The tac promoter: a functional hybrid derived from the trp and lac promoters," Proc. Natl. Acad. Sci. U.S.A. 80:21-25 (1983).
de Kraker et al., "Biosynthesis of germacrene A carboxylic acid in chicory roots. Demonstration of a cytochrome P450 (+)-germacrene A hydroxylase and NADP+-dependent sesquiterpenoid dehydrogenase(s) involved in sesquiterpene lactone biosynthesis," Plant Physiol. 125:1930-1940 (2001).
Degenhardt et al., "Monoterpene and sesquiterpene synthases and the origin of terpene skeletal biodiversity in plants," Phytochem. 70:1621-1637 (2009).
Devereux et al., "A comprehensive set of sequence analysis programs for the VAX," Nucleic Acids Res. 12(1):387-395 (1984).
Drawert et al., "Regioselective biotransformation of valencene in cell suspension cultures of Citrus sp.," Plant Cell Reports 3:37-40 (1984).
Eyal, E., "Computer modeling of the enzymatic reaction catalyzed by 5-epi-aristolochene cyclase," Masters Thesis, Department of Plant Sciences, Weizmann Institute of Science, Rehovot, Israel (Jan. 2001) [44 pages].
Fleer et al., "High-level secretion of correctly processed recombinant human interleukin-1β in *Kluyveromyces lactis*," Gene 107:285-295 (1991).
Forsburg, S., "Codon usage table for Schizosaccharomyces pombe," Yeast 10(8):1045-1047 (1994).
Fraatz et al., "Nootkatone—a biotechnological challenge," Appl. Microbiol. Biotechnol. 83(1):35-41 (2009).
Furusawa et al., "Highly efficient production of nootkatone, the grapefruit aroma from valencene, by biotransformation," Chem. Pharm. Bull. 53(11):1513-1514 (2005).
GenBank Accession No. ACX70155.1, "terpene synthase 1 [Citrus sinensis]," Retrieved from the Internet:<URL:ncbi.nlm.nih.gov/protein/ACX70155.1, Published on Oct. 20, 2009. [accessed Feb. 25, 2011] [2 pages].
GenBank Accession No. AF288465, "Citrus junos terpene synthase mRNA, complete cds," Retrieved from the Internet:<URL:ncbi.nlm.nih.gov/nucore/9864188, Published on Aug. 22, 2000. [accessed Feb. 25, 2011] [2 pages].
Genbank Accession No. AF411120 [online], "Citrus x paradisi putative terpene synthase mRNA, complete cds," Published on Apr. 2, 2002 [retrieved on Feb. 25, 2011] [retrieved from the Internet:<URL:ncbi.nlm.nih.gov/nuccore/AF411120] [2 pages].
Genbank Accession No. AF441124 [online], "Citrus sinensis valencene synthase (tps1) mRNA, complete cds," Published on Jan. 12, 2004 [retrieved on Nov. 3, 2011] [retrieved from the Internet:<URL:ncbi.nlm.nih.gov/nuccore/AF441124] [1 page].
Genbank Accession No. GQ988384 [online], "Citrus sinensis cultivar Cara Cara terpene synthase 1 (tps1) mRNA, complete cds," Published on Oct. 20, 2009 [retrieved on Nov. 3, 2011] [retrieved from the Internet:<URL:ncbi.nlm.nih.gov/nuccore/GQ988384] [1 page].
Gilbert, W. and L. Villa-Komaroff, "Useful proteins from recombinant bacteria," Sci. Am. 242(3):74-94 (1980).
Girhard et al., "Regioselective biooxidation of (+)-valencene by recombinant *E. coli* expressing CYP109B1 from Bacillus subtilis in a two-liquid-phase system," Microb. Cell Fact. 8:36 (2009).
Greenhagen, B. and J. Chappell, "Molecular scaffolds for chemical wizardry: learning nature's rules for terpene cyclases," Proc. Natl. Acad. Sci. U.S.A. 98:(2001), 13479-13481.
Greenhagen et al., "Probing sesquiterpene hydroxylase activities in a coupled assay with terpene synthases," Arch. Biochem. Biophys. 409:385-394 (2003).
Greenhagen, B., "Origins of isoprenoid diversity: A study of structure-function relationships in sesquiterpene synthases," Dissertation, College of Agriculture at the University of Kentucky (2003) [163 pages].

(56) References Cited

OTHER PUBLICATIONS

Greenhagen et al., "Identifying and manipulating structural determinates linking catalytic specificities in terpene synthases," Proc. Natl. Acad. Sci. U.S.A. 103:9826-9831 (2006).
Gribskov et al., "Sigma factors from *E. coli*, B.subtilis, phage SP01, and phage T4 are homologous proteins," Nucleic Acids Res. 14(16):6745-6763 (1986).
Hartley et al., "DNA cloning using in vitro site-specific recombination," Genome Res. 10(11):1788-1795 (2000).
Hess et al., "Cooperation of glycolytic enzymes," Adv. Enzyme Reg. 7:149-167 (1969).
Hitzeman et al., "Isolation and characterization of the yeast 3-phosphoglycerokinase gene (PGK) by an immunological screening technique," J. Biol. Chem. 255:12073-12080 (1980).
Holland, M. and J. Holland, "Isolation and identification of yeast messenger ribonucleic acids coding for enolase, glyceraldehyde-3-phosphate dehydrogenase, and phosphoglycerate kinase," Biochem. 17:4900-4907 (1978).
Hoshino et al., "5-epi-Aristolochene 3-hydroxylase from green pepper," Phytochemistry 38:609-613 (1995).
Hunter, G. and W. Brodgen, "Conversion of valencene to nootkatone," J. Food Sci. 30(5):876-878 (1965).
IUPAC-IUB Commission on Biochemical Nomenclature, "A one-letter notation for amino acid sequences. Tentative rules," J. Biol. Chem. 243:3557-3559 (1968).
Jay et al., "Construction of a general vector for efficient expression of mammalian proteins in bacteria: use of a synthetic ribosome binding site," Proc. Natl. Acad. Sci. U.S.A. 78(9):5543-5548 (1981).
Lesburg et al., "Crystal structure of pentalene synthase: mechanistic insights on terpenoid cyclization reaction in biology," Science 277:1820-1824 (1997).
Lesburg et al., "Managing and manipulating carbocations in biology: terpenoid cyclase structure and mechanism," Curr. Opin. Struc. Biol. 8:695-703 (1998).
Louzada et al., "Isolation of a terpene synthase gene from mature "Rio Red" grapefruit using differential display," Program Schedule and Abstracts for the 98th Annual International Conference of the American Society for Horticultural Science, Sacramento, CA, Jul. 22-25, 2001, HortScience 36(3):425-444 (2001).
Lucker et al., "Vitis vinifera terpenoid cyclases: functional identification of two sesquiterpene synthase cDNAs encoding (+)-valencene synthase and (−)-germacrene D synthase and expression of mono- and sesquiterpene synthases in grapevine flowers and berries," Phytochem. 65(19):2649-2659 (2004).
Martin et al., "The bouquet of grapevine (Vitis vinifera L. cv. Cabernet Sauvignon) flowers arises from the biosynthesis of sesquiterpene volatiles in pollen grains," Proc. Natl. Acad. Sci. U.S. A. 106(17):7245-7250 (2009).
Mau, C. and C. West, "Cloning of casbene synthase cDNA: evidence for conserved structural features among terpenoid cyclases in plants," Proc. Natl. Acad. Sci. U.S.A. 91:8497-8501 (1994).
Mayfield et al., "Expression and assembly of a fully active antibody in algae," Proc. Natl. Acad. Sci. U.S.A. 100(2):438-442 (2003).
Muneta et al., "Large-scale production of porcine mature interleukin-18 (IL-18) in silkworms using a hybrid baculovirus expression system," J. Vet. Med. Sci. 65(2):219-223 (2003).
Needleman, S. and C. Wunsch, "A general method applicable to the search for similarities in the amino acid sequence of two proteins," J. Mol. Biol. 48:443-453 (1970).
Newman, J. and J. Chappell, "Isoprenoid biosynthesis in plants: carbon partitioning within the cytoplasmic pathway," Crit. Rev. Biochem. Mol. Biol. 34:95-106 (1999).
Noel et al., "Structural elucidation of cisoid and transoid cyclization pathways of a sesquiterpene synthase using 2-fluorofarnesyl diphosphates," ACS Chem. Biol. 5(4):377-392 (2010).
Ohnuma et al., "A role of the amino acid residue located on the fifth position before the first aspartate-rich motif of farnesyl diphosphate sythase of determination of the final product," J. Biol. Chem. 271:30748-30754 (1996).
O'Maille et al., "Biosynthetic potential of sesquiterpene synthases: alternative products of tobacco 5-*epi*-aristolochene synthase," Arch. Biochem. Biophys. 448:73-82 (2006).
Park et al., "Metabolic engineering of *Saccharomyces cerevisiae* for the fermentative production of high-value terpenoid compounds," Abstract of presentation at Society for Industrial Microbiology Annual Meeting and Exhibition, Denver, CO (Jul. 30, 2007), 1 page.
Park et al., "Using *Saccharomyces cerevisiae* for production of terpenoid compounds for use as fragrances and flavorings," Abstract of presentation at Society for Industrial Microbiology Annual Meeting and Exhibition, San Diego, CA (Aug. 13, 2008), 1 page.
Pearson et al., "Improved tools for biological sequence comparison," Proc. Natl. Acad. Sci. U.S.A. 85(8):2444-2448 (1988).
Pham et al., "Large-scale transient transfection of serum-free suspension-growing HEK293 EBNA1 cells: peptone additives improve cell growth and transfection efficiency," Biotechnol. Bioeng. 84(3):332-342 (2003).
Ralston et al., "Biochemical and molecular characterization of 5-epi-aristolochene 3-hydroxylase, a putative regulatory enzyme in the biosynthesis of sesquiterpene phytoalexins in tobacco," Plant Interactions with Other Organisms. Annual Meeting of the American Society of Plant Physiologists. Madison, WI., Jun. 27-Jul. 1, 1998, Session 47:Abstract #737 (Poster Presentation), 2 pages.
Ralston et al., "Cloning, heterologous expression, and fuctional characterization of 5-epi-aristolochene-1,3-dihydroxylase from tobacco (*Nicotiana tabacum*)," Arch. Biochem. Biophys. 393:222-235 (2001).
Richmond, T., "Higher plant cellulose synthases," Genome Biol. 1(4):Reviews3001.1-3001.5 (2000).
Russell et al., "Nucleotide sequence of the yeast alcohol dehydrogenase II gene," J. Biol. Chem. 258:2674-2682 (1982).
Salvador, J. and J. Clark, "The allylic oxidation of unsaturated steroids by tert-butyl hydroperoxide using surface functionalised silica supported metal catalysts," Green Chem. 4:352-356 (2002).
Schwartz, R. and M. Dayhoff, eds., "Atlas of Protein Sequence and Structure," National Biomedical Research Foundation, pp. 353-358 (1979).
Sharon-Asa et al., "Citrus fruit flavor and aroma biosynthesis: isolation, functional characterization, and developmental regulation of Cstps 1, a key gene in the production of the sesquiterpene aroma compound valencene," Plant J. 36:664-674 (2003).
Sharp et al., "Codon usage patterns in *Escherichia coli, Bacillus subtilis, Saccharomyces cerevisiae, Schizosaccharomyces pombe, Drosophila melanogaster* and *Homo sapiens*; a review of the considerable within-species diversity," Nucleic Acids Res. 16(17):8207-8211 (1988).
Sharp, P. and E. Cowe, "Synonymous codon usage in *Saccharomyces cerevisiae*," Yeast 7(7):657-678 (1991).
Smith, T. and M. Waterman, "Comparison in biosequences," Adv. Appl. Math. 2(4):482-489 (1981).
Starks et al., "Structural basis for cyclic terpene biosynthesis by tobacco 5-epi-aristolochene synthase," Science 277:1815-1820 (1997).
Takahashi et al., "Metabolic engineering of sesquiterpene metabolism in yeast," Biotechnol. Bioeng. 97:170-181 (2007).
Thai et al., "Farnesol is utilized for isoprenoid biosynthesis in plant cells via farnesyl pyrophosphate formed by successive monophosphorylation reactions," Proc. Natl. Acad. Sci. U.S.A. 96:13080-13085 (1999).
Tholl, D., "Terpene synthases and the regulation, diversity and biological roles of terpene metabolism," Curr. Opin. Plant Biol. 9(3):297-304 (2006).
van den Berg et al., "Kluyveromyces as a host for heterologous gene expression: expression and secretion of prochymosin," Biotechnol. 8:135-139 (1990).
Watson et al., "Molecular Biology of the Gene," 4th Edition, Benjamin/Cummings, p. 224 (1987).
Wilson et al., "Synthesis of nootkatone from valencene," J. Agric. Food Chem. 26(6):1430-1432 (1978).
Wu et al., "Redirection of cytosolic or plastidic isoprenoid precursors elevates terpene production in plants," Nat. Biotechnol. 24:1441-1447 (2006).

(56) References Cited

OTHER PUBLICATIONS

Xiong et al., "A simple, rapid, high-fidelity and cost-effective PCR-based two-step DNA synthesis method for long gene sequences," Nucleic Acids Res. 32(12):e98, 10 pages (2004).

Zook et al., "Characterization of novel sesquiterpene biosynthesis in tobacco expressing fungal sesquiterpenoid synthase," Plant Physiol. 112:311-318 (1996).

Response to International Search Report, submitted Aug. 28, 2012, in connection with corresponding International Application No. PCT/US2011/058456, 137 pages.

Written Opinion, issued Oct. 30, 2012, in connection with corresponding International Application No. PCT/US2011/058456, 17 pages.

Dolan, K., "Allylix sniffs out biotech for new fragrances," Published on Oct. 21, 2010 [online][retrieved on Jun. 1, 2012] Retrieved from:<URL:forbes.com/forbes/2010/1108/technology-allylix-fragrances-flavor-carolyn-fritz-smell-test.html?partner=email, 1 page.

Krügener et al., "A dioxygenase of Pleurotus sapidus transforms (+)-valencene regio-specifically to (+)-nootkatone via a stereo-specific allylic hydroperoxidation," Bioresource Technol. 101(2):457-462 (2010) [Epub date Sep. 17, 2009].

Maruyama et al., "Molecular cloning, functional expression and characterization of (E)-β-farnesene synthase from Citrus junos," Biol. Pharm. Bull. 24(10):1171-1175 (2001).

Quigley, K., "Allylix raises $18.2M, announces launch of new product for fragrance market," Published on Mar. 14, 2012 [online][retrieved on Jun. 1, 2012] Retrieved from:<URL: sdbj.com/news/2012/mar/14/allylix-raises-182m-announces-launch-new-product-f, 1 page.

Talon et al., "Citrus genomics," Int. J. Plant Genomics 2008:1-17 (2008).

Letter/Written Disclosure of the Information Disclosure Statement for the above-referenced application, filed herewith on May 8, 2015, 2 pages.

GenBank Accession No. AAM00426.1, "putative terpene synthase [Citrus x paradisi]," Published on Apr. 2, 2002. Retrieved from the Internet:<URL:ncbi.nlm.nih.gov/protein/AAM00426.1>, [accessed Jan. 4, 2012], 2 pages.

GenBank Accession No. AAQ04608.1 (AF441124_1), valencene synthase [Citrus sinensis], Published on Jan. 12, 2004. Retrieved from the Internet:<URL:ncbi.nlm.nih.gov/protein/33316389, [accessed Mar. 21, 2012], 1 page.

Office Action, issued May 7, 2014, in connection with corresponding Chinese Patent Application No. 201180063409.2, 6 pages [English translation, and Office Action as issued in Chinese].

Response, filed Nov. 24, 2014, to Examination Report, issued May 7, 2014, in connection with corresponding Chinese Patent Application No. 201180063409.2, 116 pages [English language Instructions, and Response as filed in Chinese].

Office Action, issued May 20, 2014, in connection with corresponding Japanese Patent Application No. 2013-536897, 8 pages [English translation, and Office Action as issued in Japanese].

Response, filed Aug. 20, 2014, to Office Action, issued May 20, 2014, in connection with corresponding Japanese Patent Application No. 2013-536897, 221 pages [English instructions, Response as filed in Japanese, and English translation of claims as filed].

Office Action, issued Nov. 25, 2014, in connection with corresponding Japanese Patent Application Serial No. 2013-536897, 4 pages [English translation, and Office Action as issued in Japanese].

Examination Report, issued Aug. 13, 2014, in connection with corresponding Australian Patent Application No. 2013203041, 4 pages.

Examination Report, issued Aug. 13, 2014, in connection with corresponding Australian Patent Application No. 2011320127, 4 pages.

Examination Report, issued Dec. 9, 2014, in connection with corresponding European Patent Application No. 11779944.5, 4 pages.

Response, filed Mar. 16, 2015, to Examination Report, issued Dec. 9, 2014, in connection with corresponding European Patent Application No. 11779944.5, 96 pages.

Office Action, dated Feb. 13, 2015, in connection with Canadian Patent Application No. 2,815,829, 3 pages.

US 8,486,659, 07/2013, Julien et al. (withdrawn)

* cited by examiner

```
C. x paradisi (290)  MSSGETFRPTADFHPSLWRNHFLKGASDFKTVDHTATQERHEALKEEVRRMITDAEDKPV 60
C. x paradisi (291)  MSSGETFRPTADFHPSLWRNHFLKGASDFKTVDHTATQERHEALKEEVRRMITDAEDKPV 60
C. sinensis   (2)    MSSGETFRPTADFHPSLWRNHFLKGASDFKTVDHTATQERHEALKEEVRRMITDAEDKPV 60
C. x paradisi (752)  MSSGETFRPTADFHPSLWRNHFLKGASDFKTVDHTATQERHEALKEEVRRMITDAEDKPV 60
C. sinensis   (289)  MSSGETFRPTADFHPSLWRNHFLKGASDFKTVDHTATQERHEALKEEVRRMITDAEDKPV 60
C. sinensis   (886)  MSSGETFRPTADFHPSLWRNHFLKGASDFKTVDHTATQERHEALKEEVRRMITDAEDKPV 60
CVS V18       (3)    MSSGETFRPTADFHPSLWRNHFLAGASDFKTVDHTATAERHEALKEEVRRMITDAEDAPI 60
CVS V19       (4)    MSSGETFRPTADFHPSLWRNHFLQGASDFKTVDHTATNERHEALKEEVRRMITDAEDQPI 60
                     *********************** ************* ******************* *:

C. x paradisi (290)  QKLRLIDEVQRLGVAYHFEKEIEDAILKLCPIYIDSNRADLHTVSLHFRLLRQQGIKISC 120
C. x paradisi (291)  QKLRLIDEVQRLGVAYHFEKEIEDAILKLCPIYIDSNRADLHTVSLHFRLLRQQGIKISC 120
C. sinensis   (2)    QKLRLIDEVQRLGVAYHFEKEIEDAIQKLCPIYIDSNRADLHTVSLHFRLLRQQGIKISC 120
C. x paradisi (752)  QKLRLIDEVQRLGVAYHFEKEIEDAIQKLCPNYIHSNSPDLHTVSLHFRLLRQQGIKISC 120
C. sinensis   (289)  QKLRLIDEVQRLGVAYHFEKEIGDAIQKLCPIYIDSNRADLHTVSLHFRLLRQQGIKISC 120
C. sinensis   (886)  QKLRLIDEVQRLGVAYHFEKEIGDAIQKLCPIYIDSNRADLHTVSLHFRLLRQQGIKISC 120
CVS V18       (3)    QKLRLIDEVQRLGVAYHFEKEIEDAIQALCPIHIDSDKADLHTVSLHFRLLRQQGIKISC 120
CVS V19       (4)    QKLRLIDEVQRLGVAYHFEKEIEDAIQQLCPIHIDSDKADLHTVSLHFRLLRQQGIKISC 120
                     ********************** ***  ***  :*.*: .*********************

C. x paradisi (290)  DVFEKFKDDEGRFKSSLINDVQGMLSLYEAAYMAVRGEHILDEAIAFTTTHLKSLVAQDH 180
C. x paradisi (291)  DVFEKFKDDEGRFKSSLINDVQGMLSLYEAAYMAVRGEHILDEAIAFTTTHLKSLVAQDH 180
C. sinensis   (2)    DVFEKFKDDEGRFKSSLINDVQGMLSLYEAAYMAVRGEHILDEAIAFTTTHLKSLVAQDH 180
C. x paradisi (752)  DVFEKFKDDEGRFKSSLINDVQGMLSLYEAAYMAVRGEHILDEAIAFTTTHLKSLVAQDH 180
C. sinensis   (289)  DVFEKFKDDEGRFKSSLINDVQGMLSLYEAAYMAVRGEHILDEAIAFTTTHLKSLVAQDH 180
C. sinensis   (886)  DVFEKFKDDEGRFKSSLINDVQGMLSLYEAAYMAVRGEHILDEAIAFTTTHLKSLVAQDH 180
CVS V18       (3)    DVFEAFKDDEGRFKSSLINDVQGMLSLYEAAYMAVRGEHILDEAIAFTTTHLASLVAQDH 180
CVS V19       (4)    DVFEQFKDDEGRFKSSLINDVQGMLSLYEAAYMAVRGEHILDEAIAFTTTHLQSLVAQDH 180
                     **** *********************************************** *******
```

FIG. 1A

```
C. x paradisi (290)  VTPKLAEQINHALYRPLRKTLPRLEARYFMSMINSTSDHLYNKTLLNFAKLDFNILLEPH 240
C. x paradisi (291)  VTPKLAEQINHALYRPLRKTLPRLEARYFMSMINSTSDHLYNKTLLNFAKLDFNILLEPH 240
C. sinensis   (2)    VTPKLAEQINHALYRPLRKTLPRLEARYFMSMINSTSDHLYNKTLLNFAKLDFNILLELH 240
C. x paradisi (752)  VTPKLAEQINHALYRPLRKTLPRLEARYFMSMINSTSDHLYNKTLLNFAKLDFNILLELH 240
C. sinensis   (289)  VTPKLAEQINHALYRPLRKTLPRLEARYFMSMINSTSDHLCNKTLLNFAKLDFNILLELH 240
C. sinensis   (886)  VTPKLAEQINHALYRPLRKTLPRLEARYFMSMINSTSDHLCNKTLLNFAKLDFNILLELH 240
CVS V18       (3)    VTPRLAEQINHALYRPLRKTLPRLEARYIMSRIDSTSDDLVNKTLLNFAKLDFNILLDLH 240
CVS V19       (4)    VTPRLAEQINHALYRPLRKTLPRLEARYIMSRIDSTSDDLVNKTLLNFAKLDFNILLDLH 240
                     ***:************************:** *:****.* ****************: *

C. x paradisi (290)  KEELNELTKWWKDLDFTTKLPYARDRLVELYFWDLGTYFEPQYAFGRKIMTQLNYILSII 300
C. x paradisi (291)  KEELNELTKWWKDLDFTTKLPYARDRLVELYFWDLGTYFEPQYAFGRKIMTQLNYILSII 300
C. sinensis   (2)    KEELNELTKWWKDLDFTTKLPYARDRLVELYFWDLGTYFEPQYAFGRKIMTQLNYILSII 300
C. x paradisi (752)  KEELNELTKWWKDLDFTTKLPYARDRLVELYFWDLGTYFEPQYAFGRKIMTQLNYILSII 300
C. sinensis   (289)  KEELNELTKWWKDLDFTTKLPYARDRLVELYFWDLGTYFEPQYAFGRKIMTQLNYILSII 300
C. sinensis   (886)  KEELNELTKWWKDLDFTTKLPYARDRLVELYFWDLGTYFEPQYAFGRKIMTQLNYILSII 300
CVS V18       (3)    KEELNELTKWWADLDFTTKLPYARDRLVELYFWDLGTYFEPQYAFGRKIMTKLNYILSII 300
CVS V19       (4)    KEELNELTKWWQDLDFTTKLPYARDRLVELYFWDLGTYFEPQYAFGRKIMTKLNYILSII 300
                     *********** ***************************************:********

C. x paradisi (290)  DDTYDAYGTLEELSLFTEAVQRWNIEAVDMLPEYMKLIYRTLLDAFNEIEEDMAKQGRSH 360
C. x paradisi (291)  DDTYDAYGTLEELSLFTEAVQRWNIEAVDMLPEYMKLIYRTLLDAFNEIEEDMAKQGRSH 360
C. sinensis   (2)    DDTYDAYGTLEELSLFTEAVQRWNIEAVDMLPEYMKLIYRTLLDAFNEIEEDMAKQGRSH 360
C. x paradisi (752)  DDTYDAYGTLEELSLFTEAVQRWNIEAVDMLPEYMKLIYRTLLDAFNEIEEDMAKQGRSH 360
C. sinensis   (289)  DDTYDAYGTLEELSLFTEAVQRWNIEAVDMLPEYMKLIYRTLLDAFNEIEEDMAKQGRSH 360
C. sinensis   (886)  DDTYDAYGTLEELSLFTEAVQRWNIEAVDMLPEYMKLIYRTLLDAFNEIEEDMAKQGRSH 360
CVS V18       (3)    DDTYDAYGTLEELSLFTEAVARWNIEAVDMLPDYMKLIYRTLLDTFNEIEEDMAKQGRSH 360
CVS V19       (4)    DDTYDAYGTLEELSLFTEAVARWNIEAVDMLPDYMKLIYRTLLDTFNEIEEDMAKQGRSH 360
                     ******************** ***********:***********:***************
```

FIG. 1B

```
C. x paradisi (290)  CVRYAKEENQKVIGAYSVQAKWFSEGYVPTIEEYMPIALTSCAYTFVITNSFLGMGDFAT 420
C. x paradisi (291)  CVRYAKEENQKVIGAYSVQAKWFSEGYVPTIEEYMPIALTSCAYTFVITNSFLGMGDFAT 420
C. sinensis   (2)    CVRYAKEENQKVIGAYSVQAKWFSEGYVPTIEEYMPIALTSCAYTFVITNSFLGMGDFAT 420
C. x paradisi (752)  CVRYAKEENQKVIGAYSVQAKWFSEGYVPTIEEYMPIALTSCAYTFVITNSFLGMGDFAT 420
C. sinensis   (289)  CVRYAKEENQKVIGAYSVQAKWFSEGYVPTIEEYMPIALTSCAYTFVITNSFLGMGDFAT 420
C. sinensis   (886)  CVRYAKEENQKVIGAYSVQAKWFSEGYVPTIEEYMPIALTSCAYTFVITNSFLGMGDFAT 420
CVS V18       (3)    CVRYAKEEIQKVIGAYYVQAKWFSEGYVPTIEEYMPIALTSCAYRFVITNSFLGMGDFAT 420
CVS V19       (4)    CVRYAKEEIQKVIGAYYVQAKWFSEGYVPTIEEYMPIALTSCAYRFVITNSFLGMGDFAT 420
                     ******** ******* ************************* *****************

C. x paradisi (290)  KEVFEWISNNPKVVKAASVICRLMDDMQGHEFEQKRGHVASAIECYTKQHGVSKEEAIKM 480
C. x paradisi (291)  KEVFEWISNNPKVVKAASVICRLMDDMQGHEFEQKRGHVASAIECYTKQHGVSKEEAIKM 480
C. sinensis   (2)    KEVFEWISNNPKVVKAASVICRLMDDMQGHEFEQKRGHVASAIECYTKQHGVSKEEAIKM 480
C. x paradisi (752)  KEVFEWISNNPKVVKAASVICRLMDDMQGHEFEQKRGHVASAIECYTKQHGVSKEEAIKM 480
C. sinensis   (289)  KEVFEWISNNPKVVKAASVICRLMDDMQGHEFEQKRGHVASAIECYTKQHGVSKEEAIKM 480
C. sinensis   (886)  KEVFEWISNNPKVVKAASVICRLMDDMQGHEFEQKRGHVASAIECYTKQHGVSKEEAIKM 480
CVS V18       (3)    KEVFEWISGNPKVVKSASVICRLMDDMQGHEFEQKRGHVASAIECYTKQHGVSKEEAIKM 480
CVS V19       (4)    KEVFEWISGNPKVVKSASVICRLMDDMQGHEFEQKRGHVASAIECYTKQHGVSKEEAIKM 480
                     ********.******:********************************************

C. x paradisi (290)  FEEEVANAWKDINEELMMKPTVVARPLLGTILNLARAIDFIYKEDDGYTHSYLIKDQIAS 540
C. x paradisi (291)  FEEEVANAWKDIDEELMMKPTVVARPLLGTILNLARAIDFIYKEDDGYTHSYLIKDQIAS 540
C. sinensis   (2)    FEEEVANAWKDINEELMMKPTVVARPLLGTILNLARAIDFIYKEDDGYTHSYLIKDQIAS 540
C. x paradisi (752)  FEEEVANAWKDINEELMMKPTVVARPLLGTILNLARAIDFIYKEDDGYTHSYLIKDQIAS 540
C. sinensis   (289)  FEEEVANAWKDINEELMMKPTVVARPLLGTILNLARAIDFIYKEDDGYTHSYLIKDQIAS 540
C. sinensis   (886)  FEEEVANAWKDINEELMMKPTVVARPLLGTILNLARIVDFIYKEDDGYTHSYLIKDQIAS 540
CVS V18       (3)    FEEEVANAWKDINEELMMKPPVVARPLLGTILNLARAIDFIYKEDDGYTHSYLIKEQIAS 540
CVS V19       (4)    FEEEVANAWKDINEELMMKPPVVARPLLGTILNLARAIDFIYKEDDGYTHSYLIKEQIAS 540
                     ************:*******.*************** :*****************:****
```

FIG. 1C

```
C. x paradisi (290)   VLGDHVPF 548
C. x paradisi (291)   VLGDHVPF 548
C. sinensis   (2)     VLGDHVPF 548
C. x paradisi (752)   VLGDHVPF 548
C. sinensis   (289)   VLGDHVPF 548
C. sinensis   (886)   VLGDHVPF 548
CVS V18       (3)     VLGDHVPF 548
CVS V19       (4)     VLGDHVPF 548
                      ********
```

FIG. 1D

```
                                        UL 1                               AH 1
CVS    (2)    MSSGE-----------TFRPTADFHPSLWRNHFLKGASDFKTVDHTATQERHEALKEEVR 49
Vitis  (346)  MSTQVSASSLAQIPQPKNRPVANFHPNIWGDQFITYTPEDK-VTRACKEEQIEDLKKEVK 59
TEAS   (295)  MASAAVAN----YEEEIVRPVADFSPSLWGDQFLSFSIKNQVAEKYAKE--IEALKEQTR 54
HPS    (296)  -------------------------------------VDNQVAEKYAQE--IETLKEQTS 21
                                                     . : . : . :  * **::.

                  UL 2      AH 2       UL 3       AH 3        UL 4
CVS    (2)    RMITDAEDK-PVQKLRLIDEVQRLGVAYHFEKEIEDAIQKLC---PIYIDSNRADLHTVS 105
Vitis  (346)  RKLTAAAVANPSQLLNFIDAVQRLGVAYHFEQEIEEALQHICNSFHD-CNDMDGDLYNIA 118
TEAS   (295)  NMLLATGMK-LADTLNLIDTIERLGISYHFEKEIDDILDQIYNQ-----NSNCNDLCTSA 108
HPS    (296)  TMLSAACGTTLTEKLNLIDIIERLGIAYHFEKQIEDMLDHIYRADPYFEAHEYNDLNTSS 81
                :  *      : *.:** ::***::***:::*:: ::::        * . :

              AH 4              UL 5                AH 5       UL 6
CVS    (2)    LHFRLLRQQGIKISCDVFEKFKDDEGRFKSSLINDVQGMLSLYEAAYMAVRGEHILDEAI 165
Vitis  (346)  LGFRLLRQQGYTISCDIFNKFTDERGRFKEALISDVRGMLGLYEAAHLRVHGEDILAKAL 178
TEAS   (295)  LQFRLLRQHGFNISPEIFSKFQDENGKFKESLASDVLGLLNLYEASHVRTHADDILEDAL 168
HPS    (296)  VQFRLLRQHGYNVSPNIFSRFQDANGKFKESLRSDIRGLLNLYEASHVRTHKEDILEEAL 141
              : ******:* .:* ::*.:* * .*:**.:* .*: *:*.****::: .: :.** .*:

              AH 6       UL 7      AH 7      UL8     AH 8      UL 9
CVS    (2)    AFTTTHLKSLVAQDHVTPKLAEQINHALYRPLRKTLPRLEARYFMSMINSTSDHLYNKTL 225
Vitis  (346)  AFTTTHLKAMVES--LGYHLAEQVAHALNRPIRKGLERLEARWYISVYQ--DEAFHDKTL 234
TEAS   (295)  AFSTIHLES--AAPHLKSPLREQVTHALEQCLHKGVPRVETRFFISSIYDK-EQSKNNVL 225
HPS    (296)  VFSVGHLES--AAPHLKSPLSKQVTHALEQSLHKSIPRVEIRYFISIYE--EEEFKNDLL 197
              .*:. **:: .    :  * :*: ***: ::* : *:* *:::*     .:  :. *
```

FIG. 2A

```
                          AH A                            AC Loop              AH C              UL 11
CVS    (2)    LNFAKLDFNILLELHKEELNELTKWWKDLDFTTKLPYARDRLVELYFWDLGTYFEPQYAF       285
Vitis  (346)  LELAKLDFNLVQSLHKEELSNLARWWKELDFATKLPFARDRLVEGYFWMHGVYFEPQYLR         294
TEAS   (295)  LRFAKLDFNLLQMLHKQELAQVSRWWKDLDFVTTLPYARDRVVECYFWALGVYFEPQYSQ         285
HPS    (296)  LRFAKLDYNLLQMLHKHELSEVSRWWKDLDFVTTLPYARDRAVECYFWTMGVYAEPQYSQ         257
              * :****:*:: :: :****.* :**: ***:** ** ****: * :**   *.****   *.

                   AH D                        AH D1            AH D2     UL 13    UL 14              AH E
CVS    (2)    GRKIMTQLNYILSIIDDTYDAYGTLEELSLFTEAVQRWNIEAVDMLPEYMKLIYRTLLDA        345
Vitis  (346)  GRRILTKVIAMTSILDDIHDAYGTPEELKLFIEAIERWDINSINQLPEYMKLCYVALLDV        354
TEAS   (295)  ARVMLVKTISMISIVDDTFDAYGTVKELEAYTDAIQRWDINEIDRLPEYMKISYKALLDL        345
HPS    (296)  ARVMLAKTIAMISIVDDTFDAYGIVKELEVTDAIQRWDISQIDRLPEYMKISYKALLDL         317
              .*:::   :: :*::**: ****  :*  :  :*::**:*. :  *****  * .***

                  UL 15                                                        UL 16    AH G1     UL 17
CVS    (2)    FNEIEEDMAKQGRSHCVRYAKEENQKVIGAYSVQAKWFSEGYVPTIEEYMPIALTSCAYT        405
Vitis  (346)  YKEIEEEMEKEGNQYRVHYAKEVMKNQVRAYFAEEAKWLHEEHVPAFEEYMRVALASSGYC       414
TEAS   (295)  YKDYEKELSSAGRSHIVCHAIERMKEVVRNYNVESTWFIEGYTPPVSEYLSNALATTTYY        405
HPS    (296)  YDDYEKELSKDGRSDVVHYAKERMKEIVGNYFIEGKWFIEGYMPSVSEYLSNALATSTYY        377
              : : ::: .  .:*                 :           :      : **     *

               AH G2       UL 18     AH H1  UL 19                      UL 20     AH H2         AH H3     UL 21  AH a-1
CVS    (2)    FVITNSFLGMGDFATKEVFEWISNNPKVVKAASVICRLMDDMQGHEFEQKRGHVASAIEC        465
Vitis  (346)  LLATTSFVGMGEIATKEAFDWVISDPKIMSSSNFITRLMDDIKSHKFEQKRGHVASAVEC        474
TEAS   (295)  YLATTSYLGM-KSATEQDFEWLSKNPKILEASVIICRVIDDTATYEVEKSRGQIATGIEC        464
HPS    (296)  LLTTTSYLGM-KSATKEHFEWLATNPKILEANATLCRVVDDIATYEVEKGRGQIATGIEC        436
               : *:*::**  .::.:: *:*:: :**:: :  .: *:::*  .  .. :*:::: :**
```

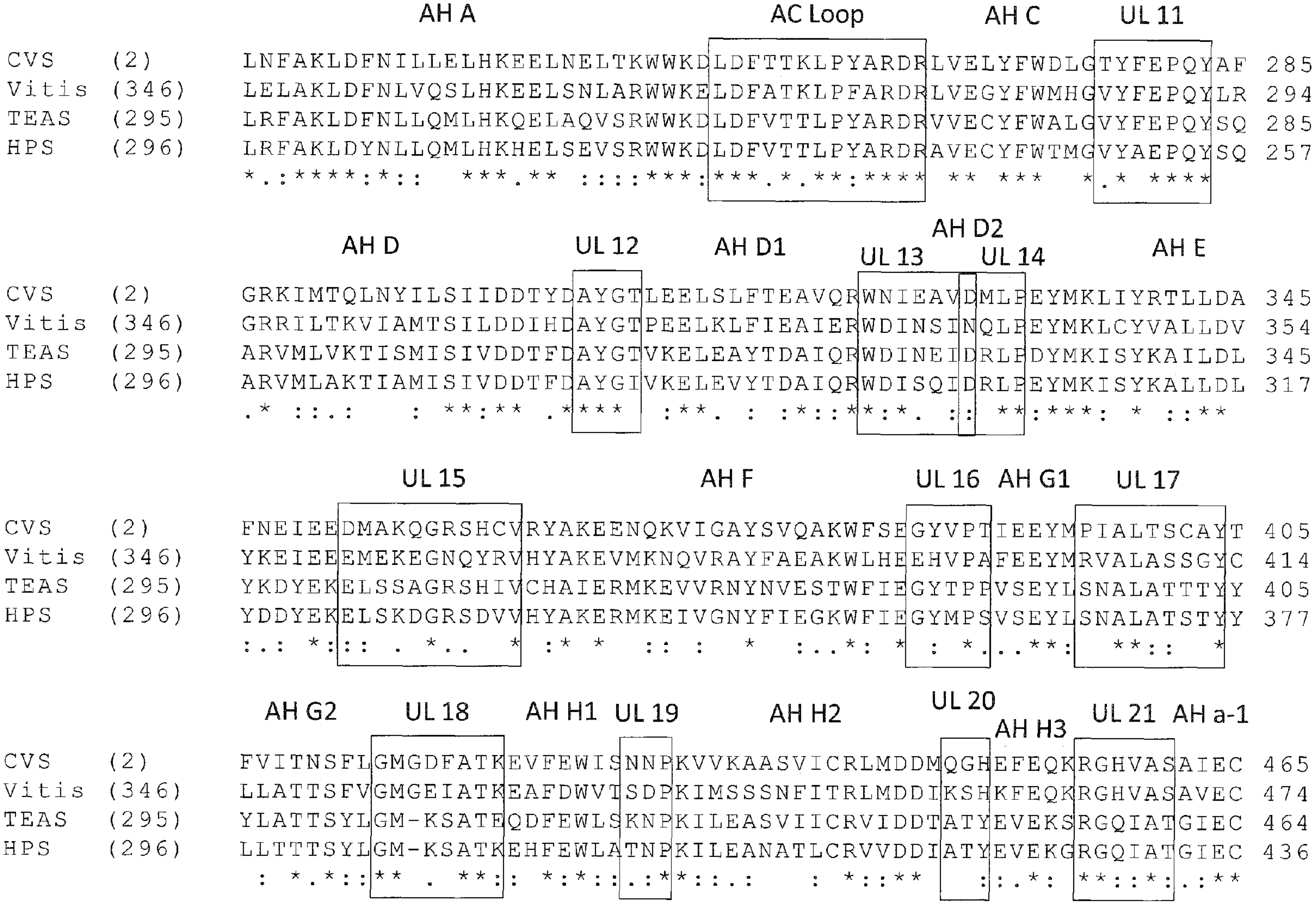

FIG. 2B

```
                 UL 22              AH I                 UL 23                AH J
CVS    (2)    YTKQHGVSKEEAIKMFEEEVANAWKDINEELMMKPTVVARPLLGTILNLARAIDEIYKED  525
Vitis  (346)  YMKQYGVSEEQVYSEFQKQIENAWLDINQEC-LKPTAVSMPLIARLLNLTRTMDVIYKEQ  533
TEAS   (295)  CMRDYGISTKEAMAKFQNMAETAWKDINEGL-LRPTPVSTEFLTPILNLARIVEVTYIHN  523
HPS    (296)  YMRDYGVSTEVAMEKFQEMADIAWKDVNEEI-LRPTPVSSEILTRILNLARIIDVTYKHN  495
               : :* :* :  . .*::*:: :* :*  . * : :*.:: * : *: **  : *

               J-K Loop      AH K        UL 25
CVS    (2)    -DGYTHS-YLIKDQIASVLGDHVPF   548
Vitis  (346)  -DSYTHVGKVMRDNIASVFINAVI-   556
TEAS   (295)  LDGYTHPEKVLKPHIINLLVDSIKI   548
HPS    (296)  QDGYTHPEKVLKPHIIALVVDSIDI   520
               *.****   :: .:*:: :..:
```

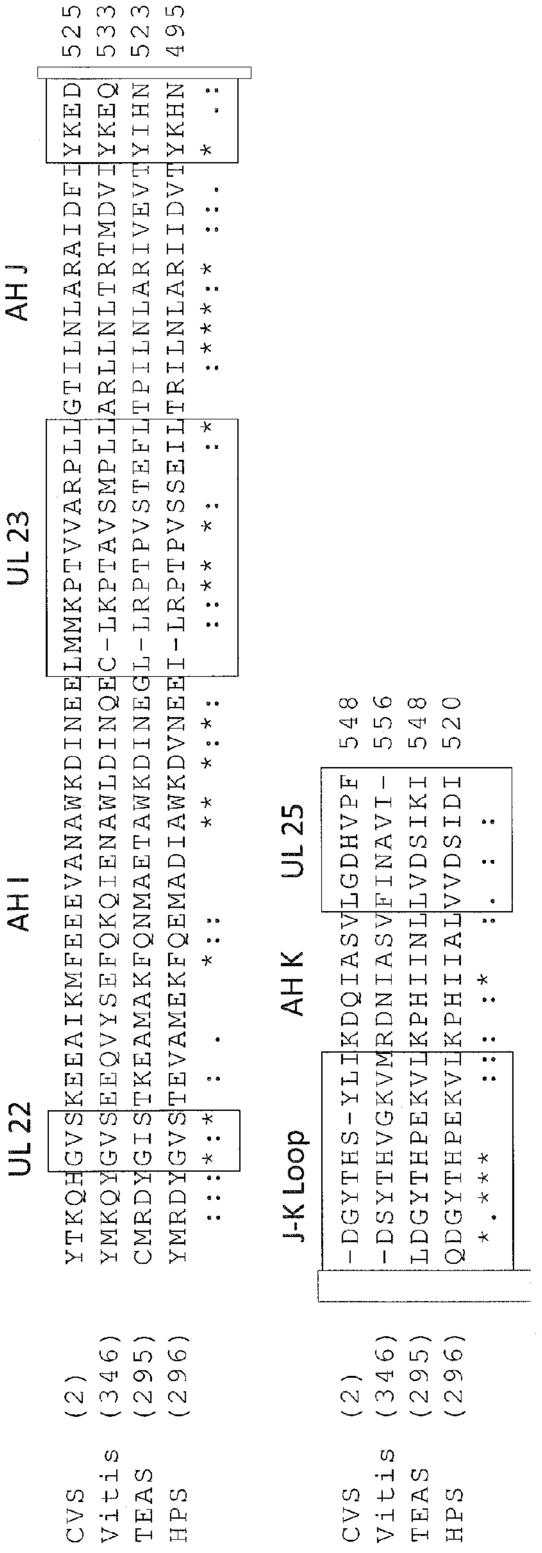

FIG. 2C

FPP

Valencene

Nootkatone

```
TEAS (295)      MASAAVANYEEEIVRPVADFSPSLWGDQFLSFSIKNQVAEKYAKEI--EALKEQTRNMLL 58
TEAS (941)      MASAAVANYEEEIVRPVADFSPSLWGDQFLSFSIDNQVAEKYAQEI--EALKEQTRSMLL 58
CVS (2)         MSSG-------ETFRPTADFHPSLWRNHFLKGASDFKTVDHTATQERHEALKEEVRRMIT 53
                *:*.       * .**.*** **** ::**. : . :..:: * :   *****:.* *:

TEAS (295)      ATGMKLADTLNLIDTIERLGISYHFEKEIDDILDQIY--NQNSNCNDLCTSALQFRLLRQ 116
TEAS (941)      ATGRKLADTLNLIDIIERLGISYHFEKEIDEILDQIY--NQNSNCNDLCTSALQFRLLRQ 116
CVS (2)         DAEDKPVQKLRLIDEVQRLGVAYHFEKEIEDAIQKLCPIYIDSNRADLHTVSLHFRLLRQ 113
                 :  * .:.*.*** ::***::*******:: ::::     :**  ** * :*:******

TEAS (295)      HGFNISPEIFSKFQDENGKFKESLASDVLGLLNLYEASHVRTHADDILEDALAFSTIHLE 176
TEAS (941)      HGFNISPEIFSKFQDENGKFKESLASDVLGLLNLYEASHVRTHADDILEDALAFSTIHLE 176
CVS (2)         QGIKISCDVFEKFKDDEGRFKSSLINDVQGMLSLYEAAYMAVRGEHILDEAIAFTTTHLK 173
                :*::** ::*.**:*::*:**.** .** *:*.****:: .:.:.**::*:**:* **:

TEAS (295)      S--AAPHLKSPLREQVTHALEQCLHKGVPRVETRFFISSIYDK-EQSKNNVLLRFAKLDF 233
TEAS (941)      S--AAPHLKSPLREQVTHALEQCLHKGVPRVETRFFISSIYDK-EQSKNNVLLRFAKLDF 233
CVS (2)         SLVAQDHVTPKLAEQINHALYRPLRKTLPRLEARYFMSMINSTSDHLYNKTLLNFAKLDF 233
                *  *  *:.. * **:.*** : *:* :**:*:*:*:* *  .. ::  *:.**.******

TEAS (295)      NLLQMLHKQELAQVSRWWKDLDFVTTLPYARDRVVECYFWALGVYFEPQYSQARVMLVKT 293
TEAS (941)      NLLQMLHKQELAQVSRWWKDLDFVTTLPYARDRVVECYFWALGVYFEPQYSQARVMLVKT 293
CVS (2)         NILLELHKEELNELTKWWKDLDFTTKLPYARDRLVELYFWDLGTYFEPQYAFGRKIMTQL 293
                *:*  ***:** ::::*******.*.*******:** *** **.******:  .* ::.:

TEAS (295)      ISMISIVDDTFDAYGTVKELEAYTDAIQRWDINEIDRLPDYMKISYKAILDLYKDYEKEL 353
TEAS (941)      ISMISIVDDTFDAYGTVKELEAYTDAIQRWDINEIDRLPDYMKISYKAILDLYKDYEKEL 353
CVS (2)         NYILSIIDDTYDAYGTLEELSLFTEAVQRWNIEAVDMLPEYMKLIYRTLLDAFNEIEEDM 353
                 ::**:***:*****::**. :*:*:***:*: :* **:***: *::** ::: *:::

TEAS (295)      SSAGRSHIVCHAIERMKEVVRNYNVESTWFIEGYTPPVSEYLSNALATTTYYYLATTSYL 413
TEAS (941)      SSAGRSHIVCHAIERMKEVVRNYNVESTWFIEGYTPPVSEYLSNALATTTYYYLATTSYL 413
CVS (2)         AKQGRSHCVRYAKEENQKVIGAYSVQAKWFSEGYVPTIEEYMPIALTSCAYTFVITNSFL 413
                :. **** * :* *. ::*:  *.*::.** ***.*.:.**:. **::  **:: :* :: *.*:*

TEAS (295)      GMKS-ATEQDFEWLSKNPKILEASVIICRVIDDTATYEVEKSRGQIATGIECCMRDYGIS 472
TEAS (941)      GMKS-ATEQDFEWLSKNPKILEASVIICRVIDDTATYEVEKSRGQIATGIECCMRDYGIS 472
CVS (2)         GMGDFATKEVFEWISNNPKVVKAASVICRLMDDMQGHEFEQKRGHVASAIECYTKQHGVS 473
                **  . **:: ***:*:***:::*: :***::**   :*.*:.**::*:.***  :::*:*

TEAS (295)      TKEAMAKFQNMAETAWKDINEG-LLRPTPVSTEFLTPILNLARIVEVTYIHNLDGYTHPE 531
TEAS (941)      TKEAMAKFQNMAETAWKDINEG-LLRPTPVSTEFLTPILNLARIVEVTYIHNLDGYTHPE 531
CVS (2)         KEEAIKMFEEEVANAWKDINEELMMKPTVVARPLLGTILNLARAIDFIYKED-DGYTH-S 531
                .:**:  *:: . .*******  :::** *:  :* .****** ::. * .: ***** .

TEAS (295)      KVLKPHIINLLVDSIKI 548
TEAS (941)      EVLKPHIINLLVDSIKI 548
CVS (2)         YLIKDQIASVLGDHVPF 548
                 ::* :* .:* * : :
```

FIGURE 4A

```
HPS (296)   ---------------------------------VDNQVAEKYA--QEIETLKEQTSTM 23
HPS (942)   MAPAIVMSNYEEEEIVRPVADFSPSLWGDHFHSFSVDNQVAEKYA--QEIETLKEQTSTM 58
CVS (2)     ---------MSSGETFRPTADFHPSLWRNHFLKGASDFKTVDHTATQERHEALKEEVRRM 51
                                             * :..:: *  :. *:***:.  *

HPS (296)   LSAACGTTLTEKLNLIDIIERLGIAYHFEKQIEDMLDHIYRADPYFEAHEYNDLNTSSVQ 83
HPS (942)   LSAACGTTLTEKLNLIDIIERLGIAYHFEKQIEDMLDHIYRADPYFEAHEYNDLNTSSVQ 118
CVS (2)     ITDAE-DKPVQKLRLIDEVQRLGVAYHFEKEIEDAIQKLC---PIYIDSNRADLHTVSLH 107
            :: *   . .:**.*** ::***:******:*** ::::    * :   :  **:* *::

HPS (296)   FRLLRQHGYNVSPNIFSRFQDANGKFKESLRSDIRGLLNLYEASHVRTHKEDILEEALVF 143
HPS (942)   FRLLRQHGYNVSPNIFSRFQDANGKFKESLRSDIRGLLNLYEASHVRTHKEDILEEALVF 178
CVS (2)     FRLLRQQGIKISCDVFEKFKDDEGRFKSSLINDVQGMLSLYEAAYMAVRGEHILDEAIAF 167
            ******:* ::* ::*.:*:* :*:**.** .*::*:*.****::: .: *.**:**:.*

HPS (296)   SVGHLES--AAPHLKSPLSKQVTHALEQSLHKSIPRVEIRYFISIYE--EEEFKNDLLLR 199
HPS (942)   SVGHLES--AAPHLKSPLSKQVTHALEQSLHKSIPRVEIRYFISIYE--EEEFKNDLLLR 234
CVS (2)     TTTHLKSLVAQDHVTPKLAEQINHALYRPLRKTLPRLEARYFMSMINSTSDHLYNKTLLN 227
            :. **:*  *  *:.. *::*:.*** :.*:*::**:* ***:*: :   .:.: *. **.

HPS (296)   FAKLDYNLLQMLHKHELSEVSRWWKDLDFVTTLPYARDRAVECYFWTMGVYAEPQYSQAR 259
HPS (942)   FAKLDYNLLQMLHKHELSEVSRWWKDLDFVTTLPYARDRAVECYFWTMGVYAEPQYSQAR 294
CVS (2)     FAKLDFNILLELHKEELNELTKWWKDLDFTTKLPYARDRLVELYFWDLGTYFEPQYAFGR 287
            *****:*:*  ***.**.*:::*******.*.******* ** *** :*.* ****: .*

HPS (296)   VMLAKTIAMISIVDDTFDAYGIVKELEVYTDAIQRWDISQIDRLPEYMKISYKALLDLYD 319
HPS (942)   VMLAKTIAMISIVDDTFDAYGIVKELEVYTDAIQRWDISQIDRLPEYMKISYKALLDLYD 354
CVS (2)     KIMTQLNYILSIIDDTYDAYGTLEELSLFTEAVQRWNIEAVDMLPEYMKLIYRTLLDAFN 347
             ::::   ::**:***:**** ::**.::*:*:***:*. :* ******: *::*** ::

HPS (296)   DYEKELSKDGRSDVVHYAKERMKEIVGNYFIEGKWFIEGYMPSVSEYLSNALATSTYYLL 379
HPS (942)   DYEKELSKDGRSDVVHYAKERMKEIVGNYFIEGKWFIEGYMPSVSEYLSNALATSTYYLL 414
CVS (2)     EIEEDMAKQGRSHCVRYAKEENQKVIGAYSVQAKWFSEGYVPTIEEYMPIALTSCAYTFV 407
            : *::::*:***. *:****. ::::* * ::.*** ***:*::.**:. **::.:* ::

HPS (296)   TTTSYLGMKS-ATKEHFEWLATNPKILEANATLCRVVDDIATYEVEKGRGQIATGIECYM 438
HPS (942)   TTTSYLGMKS-ATKEHFEWLATNPKILEANATLCRVVDDIATYEVEKGRGQIATGIECYM 473
CVS (2)     ITNSFLGMGDFATKEVFEWISNNPKVVKAASVICRLMDDMQGHEFEQKRGHVASAIECYT 467
             *.*:*** . **** ***::.***:::* :.:**::**:  :*.*: **::*:.****

HPS (296)   RDYGVSTEVAMEKFQEMADIAWKDVNEEILR-PTPVSSEILTRILNLARIIDVTYKHNQD 497
HPS (942)   RDYGVSTEVAMEKFQEMADIAWKDVNEEILR-PTPVSSEILTRILNLARIIDVTYKHNQD 532
CVS (2)     KQHGVSKEEAIKMFEEEVANAWKDINEELMMKPTVVARPLLGTILNLARAIDFIYKED-D 526
            :::***.* *:: *:* .  ****:***:: ** *:  :*  ****** **. **.: *

HPS (296)   GYTHPEKVLKPHIIALVVDSIDI 520
HPS (942)   GYTHPEKVLKPHIIALVVDSIDI 555
CVS (2)     GYTH-SYLIKDQIASVLGDHVPF 548
            **** . ::* :* ::: * : :
```

FIGURE 4B

```
Vitis (346)   MSTQVSASSLAQIPQPKNRPVANFHPNIWGDQFITYTPEDK-VTRACKEEQIEDLKKEVK 59
Vitis (347)   MSTQVSASSLAQIPQPKNRPVANFHPNIWGDQFITYTPEDK-VTRACKEEQIEDLKKEVK 59
CVS (2)       MSSGE-----------TFRPTADFHPSLWRNHFLKGASDFKTVDHTATQERHEALKEEVR 49
              **:             . **.*:***.:* ::*:. :.: * * ::..:*: * **:**:

Vitis (346)   RKLTAAAVANPSQLLNFIDAVQRLGVAYHFEQEIEEALQHICNSFHDCNDMDGDLYNIAL 119
Vitis (347)   RKLTAAAVANPSQLLNFIDAVQRLGVAYHFEQEIEEALQHICNSFHDCNDMDGDLYNIAL 119
CVS (2)       RMITDAEDK-PVQKLRLIDEVQRLGVAYHFEKEIEDAIQKLCPIYIDSNRAD--LHTVSL 106
              * :* *    * * *.:** ***********:***:*:*::*  : *.*  *  *:.::*

Vitis (346)   GFRLLRQQGYTISCDIFNKFTDERGRFKEALISDVRGMLGLYEAAHLRVHGEDILAKALA 179
Vitis (347)   GFRLLRQQGYTISCDIFNKFTDERGRFKEALISDVRGMLGLYEAAHLRVHGEDILAKALA 179
CVS (2)       HFRLLRQQGIKISCDVFEKFKDDEGRFKSSLINDVQGMLSLYEAAYMAVRGEHILDEAIA 166
               ******** .****:*:**.*:.****.:**.**:***.*****:: *:**.** :*:*

Vitis (346)   FTTTHLKAMVES--LGYHLAEQVAHALNRPIRKGLERLEARWYISVYQ--DEAFHDKTLL 235
Vitis (347)   FTTTHLKAMVES--LGYHLAEQVAHALNRPIRKGLERLEARWYISVYQ--DEAFHDKTLL 235
CVS (2)       FTTTHLKSLVAQDHVTPKLAEQINHALYRPLRKTLPRLEARYFMSMINSTSDHLYNKTLL 226
              *******::* .  :  :****: *** **:** * *****:::*:    .: ::****

Vitis (346)   ELAKLDFNLVQSLHKEELSNLARWWKELDFATKLPFARDRLVEGYFWMHGVYFEPQYLRG 295
Vitis (347)   ELAKLDFNLVQSLHKEELSNLARWWKELDFATKLPFARDRLVEGYFWMHGVYFEPQYLRG 295
CVS (2)       NFAKLDFNILLELHKEELNELTKWWKDLDFTTKLPYARDRLVELYFWDLGTYFEPQYAFG 286
              ::******:: .******.:*::***:***:****:******* ***  *.****** *

Vitis (346)   RRILTKVIAMTSILDDIHDAYGTPEELKLFIEAIERWDINSINQLPEYMKLCYVALLDVY 355
Vitis (347)   RRILTKVIAMTSILDDIHDAYGTPEELKLFIEAIERWDINSINQLPEYMKLCYVALLDVY 355
CVS (2)       RKIMTQLNYILSIIDDTYDAYGTLEELSLFTEAVQRWNIEAVDMLPEYMKLIYRTLLDAF 346
              *:*:*::  : **:** :****** ***.** **::**:*::::: ******* * :***.:

Vitis (346)   KEIEEEMEKEGNQYRVHYAKEVMKNQVRAYFAEAKWLHEEHVPAFEEYMRVALASSGYCL 415
Vitis (347)   KEIEEEMEKEGNQYRVHYAKEVMKNQVRAYFAEAKWLHEEHVPAFEEYMRVALASSGYCL 415
CVS (2)       NEIEEDMAKQGRSHCVRYAKEENQKVIGAYSVQAKWFSEGYVPTIEEYMPIALTSCAYTF 406
              :****:* *:*..: *:****  :: : ** .:***: * :**::****:***:*..* :

Vitis (346)   LATTSFVGMGEIATKEAFDWVTSDPKIMSSSNFITRLMDDIKSHKFEQKRGHVASAVECY 475
Vitis (347)   LATTSFVGMGEIATKEAFDWVTSDPKIMSSSNFITRLMDDIKSHKFEQKRGHVTSAVECY 475
CVS (2)       VITNSFLGMGDFATKEVFEWISNNPKVVKAASVICRLMDDMQGHEFEQKRGHVASAIECY 466
              : *.**:***::****.*:*::.:**::::..* *****::.*:********:**:***

Vitis (346)   MKQYGVSEEQVYSEFQKQIENAWLDINQEC-LKPTAVSMPLLARLLNLTRTMDVIYKEQD 534
Vitis (347)   MKQYGVSEEQVYSEFQKQIENAWLDINQEC-LKPTAVSMPLLARLLNFTRTMDVIYKEQD 534
CVS (2)       TKQHGVSKEEAIKMFEEEVANAWKDINEELMMKPTVVARPLLGTILNLARAIDFIYKEDD 526
               **:***:*:. . *:::: *** ***:*  :***.*: ***. :**::*::*.****:*

Vitis (346)   SYTHVGKVMRDNIASVFINAVI- 556
Vitis (347)   SYTHVGKVMRDNIASVFINAVI- 556
CVS (2)       GYTHS-YLIKDQIASVLGDHVPF 548
              .***   :::*:****: : *
```

FIGURE 4C

```
V277 (887)          MSTQVSASSLAQIPQPKNRPVANFHPNIWGDQFITYTPEDK-VTRACKEEQIEALKEEVR 59
CVS (2)             MSSGE-----------TFRPTADFHPSLWRNHFLKGASDFKTVDHTATQERHEALKEEVR 49
                    **:             . **.*:***.:* ::*:. :.: * * ::..:*: ********

V277 (887)          RMILATGRKPIQKLRLIDEVQRLGVAYHFEKEIEDMLDHIYRADPYFEAHEYNDLHTVSL 119
CVS (2)             RMITDAEDKPVQKLRLIDEVQRLGVAYHFEKEIEDAIQKLC---PIYIDSNRADLHTVSL 106
                    ***  :  **:************************ ::::    * :   :  *******

V277 (887)          HFRLLRQQGIKISCDVFEQFKDDEGRFKSSLINDVQGMLSLYEAAYMAVRGEHILDEAIA 179
CVS (2)             HFRLLRQQGIKISCDVFEKFKDDEGRFKSSLINDVQGMLSLYEAAYMAVRGEHILDEAIA 166
                    ******************:*****************************************

V277 (887)          FTTTHLQS--AAPHLKSPLAEQINHALYRPLRKTLPRLEARYIMSVY--QDEAFHNKTLL 235
CVS (2)             FTTTHLKSLVAQDHVTPKLAEQINHALYRPLRKTLPRLEARYFMSMINSTSDHLYNKTLL 226
                    ******:*  *  *:.. ************************:**:    .: ::*****

V277 (887)          NFAKLDFNILLDLHKEELNELTKWWQDLDFTTKLPYARDRLVELYFWDLGTYFESQYAFG 295
CVS (2)             NFAKLDFNILLELHKEELNELTKWWKDLDFTTKLPYARDRLVELYFWDLGTYFEPQYAFG 286
                    ***********:*************:****************************.*****

V277 (887)          RKIMTKLNYILSIIDDTYDAYGTLEECTMFSEAVARWNIEAVDMLPDYMRIIYRTLLDTF 355
CVS (2)             RKIMTQLNYILSIIDDTYDAYGTLEELSLFTEAVQRWNIEAVDMLPEYMKLIYRTLLDAF 346
                    *****:******************** ::*:*** ***********:**::*******:*

V277 (887)          NEIEEDMAKQRRSHCVRYAKEEIQKVIGAYYVQAKWFSEGYVPTIEEYMPIALTSCAYRF 415
CVS (2)             NEIEEDMAKQGRSHCVRYAKEENQKVIGAYSVQAKWFSEGYVPTIEEYMPIALTSCAYTF 406
                    ********** *********** ******* *************************** *

V277 (887)          VITNSFLGMGDFATKEVFEWISGNPKVVKSASVICRLMDDMQGHEFEQKRGHVASAIECY 475
CVS (2)             VITNSFLGMGDFATKEVFEWISNNPKVVKAASVICRLMDDMQGHEFEQKRGHVASAIECY 466
                    **********************.******:******************************

V277 (887)          TKQHGVSKEEAIKMFEEDVANAWKDINEELMMKPPVVARPLLGTILNLARAIDFIYKEDD 535
CVS (2)             TKQHGVSKEEAIKMFEEEVANAWKDINEELMMKPTVVARPLLGTILNLARAIDFIYKEDD 526
                    *****************:****************.*************************

V277 (887)          GYTHSYLIKEQIASVLGDHVPF 557
CVS (2)             GYTHSYLIKDQIASVLGDHVPF 548
                    *********:************
```

FIGURE 4D

MODIFIED VALENCENE SYNTHASE POLYPEPTIDES, ENCODING NUCLEIC ACID MOLECULES AND USES THEREOF

RELATED APPLICATIONS

Benefit of priority is claimed to U.S. Provisional Application Ser. No. 61/455,990, entitled "MODIFIED VALENCENE SYNTHASE POLYPEPTIDES AND USES THEREOF," filed on Oct. 29, 2010 to Park E., Burlingame, R. P., Amick, J. D. and Julien, B., and to U.S. Provisional Application Ser. No. 61/573,745, entitled "MODIFIED VALENCENE SYNTHASE POLYPEPTIDES, ENCODING NUCLEIC ACID MOLECULES AND USES THEREOF," filed Sep. 9, 2011 to Park, E., Burlingame, R. P., Amick, J. D., and Julien, B.

This application is related to International PCT Application No. PCT/US2011/058456, filed the same day herewith, entitled "MODIFIED VALENCENE SYNTHASE POLYPEPTIDES, ENCODING NUCLEIC ACID MOLECULES AND USES THEREOF," which claims priority to U.S. Provisional Application Ser. Nos. 61/455,990 and 61/573,745.

The subject matter of each of the above-referenced applications is incorporated by reference in its entirety.

INCORPORATION BY REFERENCE OF SEQUENCE LISTING PROVIDED ON COMPACT DISCS

An electronic version on compact disc (CD-R) of the Sequence Listing is filed herewith in duplicate (labeled Copy #1 Replacement and Copy #2 Replacement), the contents of which are incorporated by reference in their entirety. The computer-readable file on each of the aforementioned compact discs, created on Dec. 19, 2011, is identical, 3.21 megabytes in size, and titled 203SEQ.002.txt. A substitute Sequence Listing, incorporated by reference in its entirety, is provided on identical compact discs (labeled Copy #1 Replacement Mar. 21, 2012 and Copy #2 Replacement Mar. 21, 2012). The computer-readable file on each of the aforementioned compact discs, created on May 21, 2012 is identical, 3.22 megabytes in size, and titled 203SEQ.003.txt.

FIELD OF INVENTION

Provided are modified valencene synthase polypeptides, nucleic acid molecules encoding the modified valencene synthases, and methods of using the modified valencene synthase polypeptides. Also provided are methods for producing modified terpene synthases.

BACKGROUND

Valencene and nootkatone are sesquiterpenes naturally found in citrus oils, such as orange and grapefruit, and other plant matter. Valencene is derived from cyclization of the acyclic pyrophosphate terpene precursor, farnesyl diphosphate (FPP), and oxidation of valencene results in the formation of nootkatone. Although both valencene and nootkatone are used as a flavorant and fragrance, nootkatone in particular is widely used in the perfume and flavor industry. Thus, among the objects herein is the provision of modified valencene synthase polypeptides and methods of using the modified valencene synthase polypeptides for the production of valencene and nootkatone.

SUMMARY

Provided herein are nucleic acid molecules encoding modified valencene synthase polypeptides, and the modified valencene synthases encoded therein. Also provided herein are methods of making modified valencene synthase polypeptides. Also provided herein are methods for producing valencene, and methods for producing nootkatone from valencene. Also provided herein are methods for making modified terpene synthases, and the modified terpene synthases.

Provided herein are nucleic acid molecules encoding modified valencene synthase polypeptides. In some examples, the nucleic acid molecules provided herein encode a modified valencene synthase polypeptide containing a sequence of amino acids that has less than 100% identity to the modified valencene synthase polypeptide set forth in SEQ ID NO:3. In other examples, the nucleic acid molecules provided herein encode a modified valencene synthase polypeptide containing a sequence of amino acids that has 100% identity to the modified valencene synthase polypeptide set forth in SEQ ID NO:3. In some aspects, the modified valencene synthase polypeptides encoded by the nucleic acid molecules have less than 95% identity to the valencene synthase polypeptide set forth in SEQ ID NO:2. In other aspects, the modified valencene synthase polypeptides encoded by the nucleic acid molecules have greater than 62% sequence identity to the valencene synthase set forth in SEQ ID NO:2.

Also provided herein are nucleic acid molecules encoding modified valencene synthase polypeptides that contain amino acid modifications in a valencene synthase polypeptide that has a sequence of amino acids that has less than 100% sequence identity to the modified valencene synthase polypeptide set forth in SEQ ID NO:3. In some examples, the modified valencene synthase polypeptides contain a sequence of amino acids that has less than 95% identity to the valencene synthase polypeptide set forth in SEQ ID NO:2. In other examples, the modified valencene synthase polypeptides contain a sequence of amino acids that has greater than 62% sequence identity to the valencene synthase set forth in SEQ ID NO:2. In some aspects, the modified valencene polypeptide encoded by the nucleic acid molecule contains a sequence of amino acids that has at least 82% sequence identity to the valencene synthase set forth in SEQ ID NO:2.

Provided herein are nucleic acid molecules encoding modified valencene synthase polypeptides that contain or contain at least 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136 or 137 amino acid modifications compared to the valencene synthase not containing the modifications or the valencene synthase polypeptide set forth in SEQ ID NO:2.

Provided herein are nucleic acid molecules encoding modified valencene synthase polypeptides that contain a sequence of amino acids that have sequence identity to the valencene synthase set forth in SEQ ID NO:2 that is selected from among less than 95% and more than 75%; less than 94% and more than 75%; less than 93% and more than 75%; less than 92% and more than 75%; less than 95% and more than 80%; less than 94% and more than 80%; less than 93% and more than 80%; less than 92% and more than 80%; less than 95% and more than 85%; less than 94% and more than 85%;

less than 93% and more than 85%; and less than 92% and more than 85%. In some examples, the modified valencene synthase polypeptide encoded by the nucleic acid molecule provided herein has a sequence of amino acids that has less than or has about less than 94%, 93%, 92%, 91%, 90%, 89%, 88%, 87%, 86%, 85%, 84%, 83%, 82%, 81%, 80%, 79%, 78%, 77%, 76% or 75% identity to the valencene synthase set forth in SEQ ID NO:2. In other examples, the modified valencene synthase polypeptide has a sequence of amino acids that has at least 80% identity to the modified valencene synthase polypeptide set forth in SEQ ID NO:3. In yet other examples, the modified valencene synthase polypeptide has a sequence of amino acids that has at least or at least about 81%, 82%, 83%, 84%, 85%, 86%, 87%, 88%, 89%, 90%, 91%, 92%, 93%, 94%, 95%, 96%, 97%, 98%, or 99% identity to the modified valencene synthase polypeptide set forth in SEQ ID NO:3.

Also provided herein are nucleic acid molecules encoding a modified valencene synthase polypeptide containing amino acid modifications compared to the valencene synthase set forth in SEQ ID NO:2; whereby the modified valencene synthase polypeptide comprises a sequence of amino acids that has less than 100% identity and more than 62% identity to the valencene synthase polypeptide set forth in SEQ ID NO:2 and the modified valencene synthase polypeptide does not contain a sequence of amino acids set forth in any of SEQ ID NOS: 289-291, 346, 347, 752, 882, 883 or 886. In some aspects, the modified valencene synthase polypeptide does not contain a sequence of amino acids set forth in any of SEQ ID NOS: 6-8, 14-16 and 348. In other aspects, the modified valencene synthase polypeptide does not contain a sequence of amino acids set forth in SEQ ID NO: 3. In yet other aspects, the modified valencene synthase polypeptide does not contain a sequence of amino acids set forth in SEQ ID NO:5.

In some examples, the nucleic acid molecules provided herein encode a modified valencene synthase polypeptide that catalyzes the formation of valencene from an acyclic pyrophosphate terpene precursor. For example, the modified valencene synthase polypeptide catalyzes the formation of valencene from the acyclic pyrophosphate terpene precursor farnesyl diphosphate (FPP).

Also provided herein are nucleic acid molecules encoding a modified valencene synthase polypeptide that produces valencene from FPP in a host cell in an amount that is greater than the amount of valencene produced from FPP by the valencene synthase set forth in SEQ ID NO:2 in the same host cell and under the same conditions, whereby the host cells cell is a cell that produces FPP. In some aspects, the host cell is a yeast cell. The amount of valencene produced by the modified valencene synthase polypeptide can be assessed by separately culturing yeast cells expressing the modified valencene synthase polypeptide and the valencene synthase set forth in SEQ ID NO:2 under the same conditions and in the same strain of yeast and comparing the amount of valencene produced. In some examples, the amount of valencene produced from FPP by the modified valencene synthase is at least 10%, 20%, 30%, 40%, 50%, 60%, 70%, 80%, 90%, 100%, 110%, 120%, 130%, 140%, 150%, 160%, 170%, 180%, 190%, 200%, 250%, 300%, 350%, 400%, 500% or more greater than the amount of valencene produced from FPP by the valencene synthase set forth in SEQ ID NO:2. In other examples, the amount of valencene produced from FPP by the modified valencene synthase is 10% to 500%, 10% to 250%, 50% to 250%, 100% to 500% or is 100% to 250% greater than the amount of valencene produced from FPP by the valencene synthase set forth in SEQ ID NO:2. Exemplary modified valencene synthase polypeptides provided herein, for example as described below and in the Examples, produce increased valencene.

In some aspects, the modified valencene synthase polypeptide encoded by the nucleic acid molecule provided herein produces at least or about 0.1 g/L, 0.2 g/L, 0.3 g/L, 0.4 g/L, 0.5 g/L, 0.6 g/L, 0.7 g/L, 0.8 g/L, 0.9 g/L 1.0 g/L, 1.1 g/L, 1.2 g/L, 1.3 g/L, 1.4 g/L, 1.5 g/L, 2.0 g/L, 2.5 g/L, 3.0 g/L, 3.5 g/L, 4.0 g/L, 4.5 g/L, 5.0 g/L or more valencene in the yeast cell culture medium. In other aspects, modified valencene synthase polypeptide encoded by the nucleic acid molecule provided herein produces 0.1 g/L to 5.0 g/L, 0.1 g/L to 3.0 g/L, 0.5 g/L to 5.0 g/L, 1.0 g/L to 5.0 g/L or 1.0 to 3.0 g/L valencene in the yeast cell culture medium. In such examples, the valencene is produced by large scale fermentation methods. It is understood that microculture or shake flask (e.g. 50 mL) or other smaller scale methods of production, while producing increased valencene, generally produce amounts of valencene of between or about between 10 mg/L to 1000 mg/L, such as 50-60 mg/L or 600-800 mg/L.

Provided herein are nucleic acid molecules encoding a modified valencene synthase polypeptide that contains at least one amino acid modification in a valencene synthase polypeptide at a position corresponding to positions selected from among 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 50, 53, 54, 55, 56, 57, 58, 60, 62, 69, 77, 78, 82, 84, 85, 86, 87, 88, 89, 90, 91, 92, 93, 94, 95, 96, 97, 98, 99, 100, 101, 102, 103, 104, 105, 106, 107, 111, 113, 114, 116, 117, 118, 120, 121, 122, 124, 125, 127, 129, 130, 132, 135, 136, 138, 139, 141, 142, 144, 146, 151, 152, 153, 154, 155, 156, 157, 158, 159, 160, 162, 163, 165, 166, 168, 169, 170, 171, 172, 173, 174, 175, 176, 177, 178, 179, 180, 181, 182, 183, 184, 186, 187, 188, 189, 190, 191, 193, 194, 195, 196, 197, 198, 200, 201, 202, 203, 204, 205, 206, 207, 208, 209, 210, 211, 212, 213, 214, 215, 216, 217, 218, 219, 220, 221, 222, 223, 224, 227, 228, 229, 238, 252, 257, 263, 267, 268, 269, 270, 271, 272, 273, 274, 275, 276, 277, 278, 279, 280, 281, 282, 283, 284, 287, 288, 289, 290, 291, 292, 293, 294, 295, 296, 297, 298, 299, 300, 301, 302, 303, 305, 306, 307, 310, 311, 312, 313, 314, 315, 316, 317, 318, 319, 320, 321, 322, 323, 324, 325, 326, 329, 331, 332, 333, 334, 335, 336, 337, 338, 339, 340, 341, 342, 343, 344, 345, 346, 347, 348, 349, 350, 351, 352, 353, 354, 355, 356, 357, 358, 359, 360, 361, 362, 363, 364, 365, 366, 367, 368, 369, 370, 371, 372, 373, 375, 377, 378, 380, 381, 382, 386, 387, 388, 389, 390, 391, 392, 393, 394, 395, 397, 398, 399, 400, 401, 402, 403, 404, 405, 406, 407, 408, 409, 410, 411, 412, 413, 414, 415, 422, 423, 424, 428, 429, 434, 435, 436, 438, 439, 440, 441, 442, 443, 444, 445, 446, 447, 448, 449, 451, 452, 454, 457, 465, 468, 473, 474, 484, 492, 495, 496, 499, 500, 501, 506, 522, 523, 524, 525, 526, 527, 528, 529, 530, 531, 532, 533, 534, 536 and 539 by CVS numbering with reference to amino acid positions set forth in SEQ ID NO:2.

In a specific embodiment, the nucleic acid molecule provided herein encodes a modified valencene synthase polypeptide with at least one modification that is an amino acid replacement selected from among amino acid replacements corresponding to M1T, S2R, S2K, S2E, S2Q, S2P, S2T, S2L, S2H, S2A, S2V, S3D, S3R, S3G, S3I, S3E, S3V, S3A, S3T, S3L, S3M, S3N, G4K, G4V, G4N, G4I, G4R, G4S, G4P, G4A, G4E, G4F, G4C, G4T, G4L, G4Q, E5A, E5G, E5S, E5T, E5D, E5H, E5I, E5P, E5L, E5N, E5V, T6R, T6V, T6D, T6L, T6A, T6E, T6K, T6S, T6G, T6C, T6M, T6Y, F7C, F7A, F7Q, F7K, F7S, F7G, F7T, F7L, F7R, F7P, F7N, T10V, A11T, D12N, S16N, L17I, R19K, R19P, R19G, N20D, H21Q, L23S, L23I, K24A, K24Q, K24Y, K24T, G25Y, A26T, S27P, D28G, D28E, F29D, D33T, H34R, T35A, A36C, T37K, Q38V, Q38A, Q38N, Q38E, R40Q, H41I, R50G, T53L, T53R, D54A, D54P, D54C, A55T, A55P, A55R, A55V, A55Q, E56G, E56P, E56F, E56A, E56T, E56Q, D57R, D57P, D57S, D57Q, D57A, K58Q, K58R, K58P, K58E, K58A, V60I, V60G, K62R, V69I, F78L, I82V, A85M, I86L, Q87D, K88Q, K88A, K88H, L89I, C90Y, P91N, I92Y, I92N, I92S, Y93H, Y93F, Y93F, I94E, I94H, D95A, S96H, S96C, N97D, N97E, R98K, R98Y, R98D, A99N, A99M, H102Y, L106A, L106S, L106K, L106F, L111S, Q113R, I166Y, K117T, V122I, E124N, K125A, K125Q, K127T, D129E, E130R, R132G, S135E, S136A, N139S, Q142R, S146G, Y152H, M153N, M153G, H159Q, H159K, H159R, E163D, K173E, K173Q, K173A, Q178A, D179P, V181L, T182K, P183S, K184R, K184P, Q188R, I189A, I189V, I189P, T200Q, P202S, F209I, F209H, F209E, F209L, F209T, M210T, M212R, M212D, M212N, M212S, M212A, M212Y, M212K, M212F, M212H, M212Q, M212I, M212S, M212V, I213Y, I213M, I213A, I213R, I213S, I213L, I213F, I213S, I213P, I213Q, I213N, I213K, I213V, I213Y, N214D, N214E, N214S, N214L, N214Y, N214V, N214P, N214H, N214C, N214A, N214T, N214R, N214Y, N214Q, S215H, S215G, S215K, S215R, S215P, S215A, S215N, S215T, S215L, S215V, S215Q, S215D, T216Q, T216Y, T216E, T216P, T216R, T216C, T216V, T216K, T216D, T216A, T216S, T216K, S217R, S217K, S217F, S217I, S217T, S217G, S217Y, S217N, S217H, S217E, S217F, S217C, S217E, S217D, D218I, D218G, D218V, D218C, D218P, D218M, D218R, D218L, D218S, D218A, D218Y, D218K, D218E, H219D, H219A, H219L, H219C, H219W, H219R, H219S, H219F, H219E, H219G, H219Q, H219A, L220V, L220S, L220T, L220P, L220M, L220A, L220H, L220E, L220G, L220D, L220F, Y221C, Y221V, Y221Q, Y221F, Y221S, Y221N, Y221T, Y221P, Y221L, Y221K, Y221W, Y221E, Y221V, Y221H, N227S, E238D, K252A, K252Q, T257A, D274M, D274N, D274S, D274F, D274G, D274H, D274E, F279S, F279I, F279P, F279D, F279L, F279N, F279M, F279H, F279C, F279A, F279G, F279W, E280L, P281S, P281H, P281K, P281A, P281W, P281L, P281Y, Q282L, Q282S, Q282A, Q282I, Q282R, Q282Y, Q282G, Q282W, Q282P, Q282E, Y283F, Y283N, A284T, A284G, A284P, A284V, A284R, A284D, A284E, A284S, A284H, A284K, A284I, A284W, A284M, Q292K, I299Y, Y307H, L310H, E311P, E311T, L313C, S314A, S314T, L315M, F316L, T317S, E318K, A319T, V320D, V320G, V320S, Q321A, W323R, N324S, I325T, E326K, E333D, K336R, L337I, L343V, A345V, A345T, N347L, N347S, E348A, E348S, E350K, G357R, H360L, H360A, C361R, V362A, E367G, N369I, Q370D, Q370H, Q370G, K371G, A375D, S377Y, Y387C, I397V, L399S, T405R, T409G, N410S, F424L, N429S, N429G, A436S, V439L, Q448L, C465S, K468Q, S473Y, K474T, E484D, I492V, E495G, K499E, P500L, T501P, P506S, D536E and A539V by CVS numbering with reference to positions set forth in SEQ ID NO:2.

In one embodiment, the nucleic acid molecule provided herein encodes a modified valencene synthase polypeptide with at least one modification that is an amino acid replacement and at least one amino acid replacement is at a position corresponding to positions selected from among 1, 2, 3, 4, 5, 6, 7, 11, 19, 20, 23, 24, 28, 38, 50, 53, 54, 55, 56, 57, 58, 60, 62, 69, 78, 82, 88, 93, 97, 98, 102, 106, 111, 113, 125, 132, 152, 153, 159, 163, 173, 184, 188, 189, 200, 202, 209, 210, 212, 213, 214, 215, 216, 217, 218, 219, 220, 221, 227, 238, 252, 257, 274, 279, 280, 281, 282, 283, 284, 292, 297, 299, 307, 310, 311, 313, 314, 315, 316, 317, 318, 319, 320, 321, 323, 324, 325, 326, 333, 336, 337, 343, 345, 347, 348, 350, 357, 360, 361, 362, 367, 369, 370, 371, 375, 377, 387, 397, 399, 405, 409, 410, 424, 429, 436, 439, 448, 465, 468, 473, 474, 484, 492, 495, 499, 500, 501, 506, 536 and 539 by CVS numbering with reference to positions set forth in SEQ ID NO:2. For example, at least one amino acid replacement in the modified valencene synthase polypeptide can be selected from among amino acid replacements corresponding to M1T, S2R, S2K, S2E, S2Q, S2P, S2T, S2L, S2H, S2A, S2V, S3D, S3R, S3G, S3I, S3E, S3V, S3A, S3T, S3L, S3M, S3N, G4K, G4V, G4N, G4I, G4R, G4S, G4P, G4A, G4E, G4F, G4C, G4T, G4L, E5A, E5G, E5S, E5T, E5D, E5H, E5I, E5P, E5L, E5N, T6R, T6V, T6D, T6L, T6A, T6E, T6K, T6S, T6G, T6C, T6M, T6Y, F7C, F7A, F7Q, F7K, F7S, F7G, F7T, F7L, F7R, F7P, A11T, R19K, R19P, N20D, L23S, K24A, K24Q, K24Y, D28G, Q38V, Q38A, Q38N, R50G, T53L, T53R, D54A, D54P, D54C, A55T, A55P, A55R, A55V, A55Q, E56G, E56P, E56F, E56A, E56T, E56Q, D57R, D57P, D57S, D57Q, D57A, K58Q, K58R, K58P, K58E, K58A, V60I, V60G, K62R, V69I, F78L, I82V, K88Q, K88A, Y93H, N97D, R98K, H102Y, L106A, L106S, L106K, L106F, L111S, Q113R, K125A, K125Q, R132G, Y152H, M153N, M153G, H159Q, H159K, H159R, E163D, K173E, K173Q, K173A, K184R, Q188R, I189A, I189V, I189P, T200Q, P202S, F209I, F209H, F209E, F209L, F209T, M210T, M212R, M212D, M212N, M212S, M212A, M212Y, M212K, M212F, M212H, M212Q, I213Y, I213M, I213A, I213R, I213S, I213L, I213F, I213S, I213P, I213Q, I213N, I213K, I213V, N214D, N214E, N214S, N214L, N214Y, N214V, N214P, N214H, N214C, N214A, N214T, N214R, S215H, S215G, S215K, S215R, S215P, S215A, S215N, S215T, S215L, S215V, S215Q, T216Q, T216Y, T216E, T216P, T216R, T216C, T216V, T216K, T216D, T216A, T216S, S217R, S217K, S217F, S217I, S217T, S217G, S217Y, S217N, S217H, S217E, S217F, S217C, D218I, D218G, D218V, D218C, D218P, D218M, D218R, D218L, D218S, D218A, D218Y, D218K, H219D, H219A, H219L, H219C, H219W, H219R, H219S, H219F, H219E, L220V, L220S, L220T, L220P, L220M, L220A, L220H, L220E, L220G, L220D, Y221C, Y221V, Y221Q, Y221F, Y221S, Y221N, Y221T, Y221P, Y221L, Y221K, Y221W, Y221E, Y221V, N227S, E238D, K252A, K252Q, T257A, D274M, D274N, D274S, D274F, D274G, D274H, D274E, F279S, F279I, F279P, F279D, F279L, F279N, F279M, F279H, F279C, F279A, F279G, F279W, E280L, P281S, P281H, P281K, P281A, P281W, P281L, P281Y, Q282L, Q282S, Q282A, Q282I, Q282R, Q282Y, Q282G, Q282W, Q282P, Q282E, Y283F, Y283N, A284T, A284G, A284P, A284V, A284R, A284D, A284E, A284S, A284H, A284K, A284I, A284W, A284M, Q292K, I299Y, Y307H, L310H, E311P, E311T, L313C, S314A, S314T, L315M, F316L, T317S, E318K, A319T, V320D, V320G, V320S, Q321A, W323R, N324S, I325T, E326K, E333D, K336R, L337I, L343V, A345V, A345T, N347L, N347S, E348A, E348S, E350K, G357R, H360L, H360A, C361R, V362A, E367G, N369I, Q370D, Q370H, Q370G, K371G, A375D, S377Y, Y387C, I397V, L399S, T405R, T409G, N410S, F424L, N429S, N429G, A436S, V439L, Q448L, C465S, K468Q, S473Y, K474T, E484D, I492V, E495G, K499E, P500L, T501P, P506S, D536E and A539V by CVS numbering with reference to positions set forth in SEQ ID NO:2.

In another embodiment, the modified valencene synthase encoded by the nucleic acid molecule provided herein contains amino acid replacements at positions corresponding to positions selected from among 60, 97, 209, 212, 214, 221, 238, 292, 333, 345, 369, 405, 429, 473 and/or 536, with numbering relative to the valencene synthase polypeptide set forth in SEQ ID NO:2. For example, the encoded modified valencene synthase polypeptide contains amino acid replacements selected from among V60I, V60G, N97D, F209I, F209H, F209E, F209L, F209T, M212R, M212D, M212N, M212S, M212A, M212Y, M212K, M212F, M212H, M212Q, N214D, N214E, N214S, N214L, N214Y, N214V, N214P, N214H, N214C, N214A, N214T, N214R, Y221C, Y221V, Y221Q, Y221F, Y221S, Y221N, Y221T, Y221P, Y221L, Y221K, Y221W, Y221E, Y221V, E238D, Q292K, E333D, A345V, A345T, N369I, T405R, N429S, N429G, S473Y, and/or D536E by CVS numbering with reference to positions set forth in SEQ ID NO:2.

Among the nucleic acid molecules provided herein are those that encode modified valencene synthase polypeptides that contain amino acid replacements selected from among replacements corresponding to N214D/S473Y; T405R; A345V/D536E; Y221C; E238D; F209I; N97D; E333D/N369I; N214D/T405R; N214D/A345V/T405R/D536E; V60I/N214D/A345T/T405R; N214D/T405R/N429S; N214D/Q292K/T405R; V60G/N214D/T405R; V60I/N214D/A345T/T405R/N429S; V60I/M212R/N214D/Y221V/A345T/T405R/N429G, by CVS numbering with numbering relative to positions set forth in SEQ ID NO:2.

In some examples, the nucleic acid molecule provided herein encodes a modified valencene synthase having amino acid replacements at positions corresponding to positions 60, 209, 238 and 292 by CVS numbering with numbering relative to positions in the valencene synthase polypeptide set forth in SEQ ID NO:2. For example, the encoded modified valencene synthase polypeptide contains a replacement at position V60 that is V60I or V60G; a replacement at position F209 that is F209I, F209H, F209E, F209L or F209T; a replacement at position E238 that is E238D; and a replacement at position Q292, that is Q292K, each by CVS numbering with numbering relative to positions set forth in SEQ ID NO:2.

In some examples, the nucleic acid molecule provided herein encodes a modified valencene synthase having amino acid replacements at positions corresponding to positions 60, 125, 173, 209, 238, 252 and 292 with numbering relative to the valencene synthase polypeptide set forth in SEQ ID NO:2. For example, the encoded modified valencene synthase polypeptide contains a replacement at position V60 that is V60I or V60G; a replacement at position K125 that is K125A or K125Q; a replacement at position K173 that is K173E, K173Q or K173A; a replacement at position F209 that is F209I, F209H, F209E, F209L or F209T; a replacement at position E238 that is E238D; a replacement at position K252 that is K252Q; and a replacement at position Q292, that is Q292K, each by CVS numbering with numbering relative to positions set forth in SEQ ID NO:2.

Among the nucleic acid molecules provided herein are those that encode modified valencene synthase polypeptides that contain amino acid replacements selected from among replacements corresponding to:

K24A/Q38A/K58A/V60I/K88A/Y93H/N97D/R98K/K125A/K173A/K184R/F209I/M212R/N214D/H219D/Y221V/E238D/K252A/Q292K/Q321A/E333D/A345T/N369I/S377Y/T405R/N429G/A436S/T501P/D536E;

K24Q/Q38N/K58Q/V60I/K88Q/Y93H/N97D/R98K/K125Q/K173Q/K184R/F209I/M212R/N214D/H219D/Y221V/E238D/K252Q/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/Q292K/V320S/Q321A/E326K/E333D/A345T/N369I/S377Y/T405R/N429G/A436S/T501P/D536E;

K24A/Q38A/R50G/K58A/V60I/K88A/Y93H/N97D/R98K/K125A/K173A/K184R/F209I/M212R/N214D/H219D/Y221V/E238D/K252A/Q292K/V320G/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/Q292K/L315M/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/Q292K/V320G/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/Q292K/Q321A/E333D/A345T/G357R/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/Q292K/Q321A/E333D/A345T/N369I/E367G/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/Q292K/Q321A/E333D/A345T/N369I/Q370D/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/Q292K/I299Y/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/Q292K/Q321A/E333D/A345T/H360L/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/Q292K/T317S/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/Q292K/V320D/Q321A/E333D/A345T/N369I/S377Y/T405R/N429G/A436S/T501P/D536E;

K24A/Q38V/K58A/V60I/K88A/Y93H/N97D/R98K/K125A/K173A/K184R/F209I/M212R/N214D/H219D/Y221V/E238D/K252A/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/Q292K/Q321A/E333D/A345T/N369I/S377Y/T405R/T409G/N429G/A436S/E495G/T501P/D536E;

K24A/Q38A/K58A/V60I/K88A/Y93H/N97D/R98K/K125A/K173A/K184R/F209I/M212R/N214D/H219D/Y221V/E238D/K252A/P281S/Q292K/Q321A/E333D/L337I/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/Q292K/Q321A/E333D/A345T/N369I/A375D/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/Q292K/Q321A/E333D/K336R/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/Q292K/E311P/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/Q292K/Q321A/E333D/A345T/N369I/Q370H/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/Q292K/Q321A/E333D/L343V/A345T/H360A/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/Q282S/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/Q292K/Q321A/E333D/A345T/N369I/K371G/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/Q292K/Q321A/E333D/A345T/N347L/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/Q292K/E311T/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/Q282L/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/Q292K/S314T/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/Q292K/Q321A/E333D/A345T/N369I/Q370G/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/Q292K/L310H/Q321A/E333D/A345T/V362A/N369I/S377Y/T405R/N429G/A436S/T501P/D536E;

K24A/Q38A/K58A/V60I/F78L/K88A/Y93H/N97D/R98K/K125A/K173A/K184R/F209I/M212R/N214D/H219D/Y221V/E238D/K252A/Q292K/L313C/Q321A/E333D/A345T/N369I/S377Y/T405R/N429G/A436S/T501P/D536E;

K24Q/Q38N/K58Q/V60I/K88Q/Y93H/N97D/R98K/K125Q/K173Q/K184R/F209I/M212R/N214D/H219D/Y221V/E238D/K252Q/P281S/Q292K/I299Y/L310H/E311P/Q321A/E333D/A345T/N369I/S377Y/T405R/N429G/A436S/T501P/D536E;

K24Q/Q38N/K58Q/V60I/K88Q/Y93H/N97D/R98K/K125Q/K173Q/K184R/F209I/M212R/N214D/H219D/Y221V/E238D/K252Q/P281S/Q282L/Q292K/L310H/Q321A/E333D/A345T/N369I/S377Y/T405R/N429G/A436S/T501P/D536E;

K24Q/Q38N/K58Q/V60I/K88Q/Y93H/N97D/R98K/K125Q/K173Q/K184R/F209I/M212R/N214D/H219D/Y221V/E238D/K252Q/P281S/Q282L/Q292K/I299Y/E311P/Q321A/E333D/A345T/N369I/S377Y/T405R/N429G/A436S/T501P/D536E;

K24Q/Q38N/K58Q/V60I/K88Q/Y93H/N97D/R98K/K125Q/K173Q/K184R/F209I/M212R/N214D/H219D/Y221V/E238D/K252Q/P281S/Q292K/L313C/S314T/L315M/T317S/Q321A/E333D/A345T/N369I/S377Y/T405R/N429G/A436S/T501P/D536E;

K24Q/Q38N/K58Q/V60I/K88Q/Y93H/N97D/R98K/K125Q/K173Q/K184R/F209I/M212R/N214D/H219D/Y221V/E238D/K252Q/P281S/Q292K/Q321A/E333D/K336R/A345T/N347L/G357R/N369I/S377Y/T405R/N429G/A436S/T501P/D536E;

K24Q/Q38N/K58Q/V60I/K88Q/Y93H/N97D/R98K/K125Q/K173Q/K184R/F209I/M212R/N214D/H219D/Y221V/E238D/K252Q/Q292K/L310H/E311T/L313C/S314T/L315M/T317S/V320G/Q321A/E333D/A345T/N369I/S377Y/T405R/N429G/A436S/T501P/D536E;

K24Q/Q38N/K58Q/V60I/K88Q/Y93H/N97D/R98K/K125Q/K173Q/K184R/F209I/M212R/N214D/H219D/Y221V/E238D/K252Q/P281S/Q292K/T317S/Q321A/E333D/K336R/L337I/A345T/N347L/G357R/N369I/S377Y/T405R/N429G/A436S/T501P/D536E;

K24Q/Q38N/K58Q/V60I/K88Q/Y93H/N97D/R98K/K125Q/K173Q/K184R/F209I/M212R/N214D/H219D/Y221V/E238D/K252Q/Q292K/T317S/Q321A/E333D/K336R/L337I/A345T/G357R/N369I/S377Y/T405R/N429G/A436S/T501P/D536E;

K24Q/Q38N/K58Q/V60I/K88Q/Y93H/N97D/R98K/K125Q/K173Q/K184R/F209I/M212R/N214D/H219D/Y221V/E238D/K252Q/P281S/Q292K/T317S/Q321A/E333D/K336R/A345T/N347L/G357R/N369I/S377Y/T405R/N429G/A436S/T501P/D536E;

K24Q/Q38N/K58Q/V60I/K88Q/Y93H/N97D/R98K/K125Q/K173Q/K184R/F209I/M212R/N214D/H219D/Y221V/E238D/K252Q/P281S/Q292K/T317S/Q321A/E333D/A345T/G357R/N369I/S377Y/T405R/N429G/A436S/T501P/D536E;

K24Q/Q38N/K58Q/V60I/K88Q/Y93H/N97D/R98K/K125Q/K173Q/K184R/F209I/M212R/N214D/H219D/Y221V/E238D/K252Q/P281S/Q292K/L310H/E311T/L313C/T317S/V320G/Q321A/E333D/A345T/N369I/S377Y/T405R/N429G/A436S/T501P/D536E;

K24Q/Q38N/K58Q/V60I/K88Q/Y93H/N97D/R98K/K125Q/K173Q/K184R/F209I/M212R/N214D/H219D/Y221V/E238D/K252Q/P281S/Q292K/L313C/S314T/L315M/T317S/Q321A/E333D/K336R/A345T/N347LG357R/N369I/S377Y/T405R/N429G/A436S/T501P/D536E;

K24Q/Q38N/K58Q/V60I/K88Q/Y93H/N97D/R98K/K125Q/K173Q/K184R/F209I/M212R/N214D/H219D/Y221V/E238D/K252Q/Q292K/Q321A/E333D/A345T/N369I/Q370D/A375D/S377Y/T405R/T409G/N429G/A436S/E495G/T501P/D536E;

K24Q/Q38N/K58Q/V60I/K88Q/Y93H/N97D/R98K/K125Q/K173Q/K184R/F209I/M212R/N214D/H219D/Y221V/E238D/K252Q/P281S/Q292K/L313C/S314T/

L315M1T317S/Q321A/E333D/K336R/L337I/A345T/N347L/G357R/N369I/S377Y/T405R/N429G/A436S/T501P/D536E;

K24Q/Q38N/K58Q/V60I/K88Q/Y93H/N97D/R98K/K125Q/K173Q/K184R/F209I/M212R/N214D/H219D/Y221V/E238D/K252Q/P281S/Q292K/L313C/S314T/L315M/T317S/Q321A/E333D/K336R/L337I/A345T/G357R/N369I/S377Y/T405R/N429G/A436S/T501P/D536E;

S2R/S3D/G4K/E5G/F7C/K24Q/Q38N/K58Q/V60I/K88Q/Y93H/N97D/R98K/K125Q/K173Q/K184R/F209I/M212R/N214D/H219D/Y221V/E238D/K252Q/Q292K/Q321A/E333D/A345T/N369I/S377Y/T405R/N429G/A436S/T501P/D536E;

S2E/S3G/G4N/E5S/T6V/F7Q/K24Q/Q38N/K58Q/V60I/K88Q/Y93H/N97D/R98K/K125Q/K173Q/K184R/F209I/M212R/N214D/H219D/Y221V/E238D/K252Q/Q292K/Q321A/E333D/A345T/N369I/S377Y/T405R/F424L/N429G/A436S/T501P/D536E;

S2K/S3R/G4V/E5G/T6R/F7A/K24Q/Q38N/K58Q/V60I/K88Q/Y93H/N97D/R98K/K125Q/K173Q/K184R/F209I/M212R/N214D/H219D/Y221V/E238D/K252Q/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/D274M/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/D274N/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/D274S/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/D274F/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/D274G/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/D274H/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/D274E/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/F279S/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/F279I/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/F279P/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/F279D/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/F279L/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/F279N/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/A281W/Q292K/Q321A/E333D/A345T/E350K/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/F279M/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/F279H/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/F279C/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/P281W/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/F279A/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/F279G/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/F279W/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/

Y221V/E238D/K252A/P281H/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/P281K/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/P281A/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/P281S/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/P281W/Y283F/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/P281A/Q282P/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/Q292K/F316L/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/E280L/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/P281L/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/P281Y/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/P281L/Q282P/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/Q282S/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/Q282A/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/

Y221V/E238D/K252A/Q282I/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/Q282R/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/Q282Y/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/Q282L/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/Q282G/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/Q282G/Q292K/Q321A/N324S/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/Q282A/Q292K/Q321A/E333D/A345T/N347S/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/Q282W/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/Q282P/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/Q282E/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/A284T/Q292K/Y307H/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/A284G/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/A284P/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/

Y221V/E238D/K252A/A284G/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/A284V/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/A284G/Q292K/D301X/Q321A/E333D/A345T/R358X/N369I/S377Y/V378X/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/A284R/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/A284D/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/A284E/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/Y283N/A284S/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/A284H/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/A284K/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/A284K/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/A284W/Q292K/Q321A/E333D/L342X/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/A284T/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/A284M/Q292K/Q321A/W323R/E333D/A345T/N369I/S377Y/T405R/N429G/A436S/T501P/D536E;

K24Q/Q38N/K58Q/V60I/K88Q/Y93H/N97D/R98K/K125Q/K173Q/K184R/F209I/M212R/N214D/H219D/Y221V/E238D/K252Q/P281S/Q282S/Q292K/E311P/Q321A/E333D/A345T/N369I/S377Y/T405R/N429G/A436S/T501P/D536E;

K24Q/Q38N/K58Q/V60I/K88Q/Y93H/N97D/R98K/K125Q/K173Q/K184R/F209I/M212R/N214D/H219D/Y221V/E238D/K252Q/P281S/Q282S/Q292K/L310H/E318K/Q321A/E333D/A345T/N369I/S377Y/T405R/N429G/A436S/T501P/D536E;

K24Q/Q38N/K58Q/V60I/K88Q/Y93H/N97D/R98K/K125Q/K173Q/K184R/F209I/M212R/N214D/H219D/Y221V/E238D/K252Q/P281S/Q282S/Q292K/L310H/Q321A/E333D/A345T/N369I/S377Y/T405R/N429G/A436S/T501P/D536E;

K24Q/Q38N/K58Q/V60I/K88Q/Y93H/N97D/R98K/K125Q/K173Q/K184R/F209I/M212R/N214D/H219D/Y221V/E238D/K252Q/Q292K/E311P/Q321A/E333D/A345T/N369I/S377Y/T405R/N429G/A436S/T501P/D536E;

K24Q/Q38N/K58Q/V60I/K88Q/Y93H/N97D/R98K/K125Q/K173Q/K184R/F209I/M212R/N214D/H219D/Y221V/E238D/K252Q/Q292K/T317S/V320G/Q321A/E333D/A345T/N369I/S377Y/T405R/N429G/A436S/T501P/D536E;

K24Q/Q38N/K58Q/V60I/K88Q/Y93H/N97D/R98K/K125Q/K173Q/K184R/F209I/M212R/N214D/H219D/Y221V/E238D/K252Q/Q292K/Q321A/E333D/A345T/H360L/N369I/Q370H/A375D/S377Y/T405R/T409G/N429G/A436S/E495G/T501P/D536E;

K24Q/Q38N/K58Q/V60I/K88Q/Y93H/N97D/R98K/K125Q/K173Q/K184R/F209I/M212R/N214D/H219D/Y221V/E238D/K252Q/Q292K/Q321A/E333D/A345T/N369I/Q370H/A375D/S377Y/T405R/T409G/N429G/A436S/E495G/T501P/D536E;

S2P/S3R/G4R/E5D/T6R/F7A/K24Q/Q38N/K58Q/V60I/K88Q/Y93H/N97D/R98K/K125Q/K173Q/K184R/F209I/M212R/N214D/H219D/Y221V/E238D/K252Q/Q292K/Q321A/E333D/A345T/N369I/S377Y/T405R/N429G/A436S/T501P/D536E;

S3L/G4S/E5H/T6D/F7S/K24Q/Q38N/K58Q/V60I/K88Q/Y93H/N97D/R98K/K125Q/K173Q/K184R/F209I/M212R/N214D/H219D/Y221V/E238D/K252Q/Q292K/Q321A/E333D/A345T/N369I/S377Y/T405R/N429G/A436S/T501P/D536E;

S2T/S3R/E5I/T6L/F7K/K24Q/Q38N/K58Q/V60I/K88Q/Y93H/N97D/R98K/K125Q/K173Q/K184R/F209I/M212R/N214D/H219D/Y221V/E238D/K252Q/Q292K/Q321A/E333D/A345T/N369I/S377Y/T405R/N429G/A436S/T501P/D536E;

S2L/S3D/G4S/E5I/T6A/F7G/K24Q/Q38N/K58Q/V60I/K88Q/Y93H/N97D/R98K/K125Q/K173Q/K184R/F209I/M212R/N214D/H219D/Y221V/E238D/K252Q/Q292K/Q321A/E333D/A345T/N369I/S377Y/T405R/N429G/A436S/T501P/D536E;

S2H/S3E/G4P/E5S/T6E/F7T/K24Q/Q38N/K58Q/V60I/K88Q/Y93H/N97D/R98K/K125Q/K173Q/K184R/F209I/M212R/N214D/H219D/Y221V/E238D/K252Q/Q292K/Q321A/E333D/A345T/N369I/S377Y/T405R/N429G/A436S/T501P/D536E;

S2L/S3G/G4V/E5S/T6E/F7Q/K24Q/Q38N/K58Q/V60I/K88Q/Y93H/N97D/R98K/K125Q/K173Q/K184R/F209I/M212R/N214D/H219D/Y221V/E238D/K252Q/Q292K/Q321A/E333D/A345T/N369I/S377Y/T405R/N429G/A436S/T501P/D536E;

S2R/S3V/G4A/E5P/T6K/K24Q/Q38N/K58Q/V60I/K88Q/Y93H/N97D/R98K/K125Q/K173Q/K184R/F209I/

M212R/N214D/H219D/Y221V/E238D/K252Q/Q292K/Q321A/E333D/A345T/N369I/S377Y/T405R/N429G/A436S/T501P/D536E;

S2R/S3A/G4E/E5L/T6S/F7L/K24Q/Q38N/K58Q/V60I/K88Q/Y93H/N97D/R98K/K125Q/K173Q/K184R/F209I/M212R/N214D/H219D/Y221V/E238D/K252Q/Q292K/Q321A/E333D/A345T/N369I/S377Y/T405R/N429G/A436S/T501P/D536E;

S2Q/G4I/E5T/T6D/F7K/K24Q/Q38N/K58Q/V60I/K88Q/Y93H/N97D/R98K/K125Q/K173Q/K184R/F209I/M212R/N214D/H219D/Y221V/E238D/K252Q/Q292K/Q321A/E333D/A345T/N369I/S377Y/T405R/N429G/A436S/T501P/D536E;

S2R/S3V/G4I/E5D/T6G/F7G/K24Q/Q38N/K58Q/V60I/K88Q/Y93H/N97D/R98K/K125Q/K173Q/K184R/F209I/M212R/N214D/H219D/Y221V/E238D/K252Q/Q292K/Q321A/E333D/A345T/N369I/S377Y/T405R/N429G/A436S/T501P/D536E;

K24Q/Q38N/K58Q/V60I/K88Q/Y93H/N97D/R98K/L106A/K125Q/K173Q/K184R/F209I/M212R/N214D/H219D/Y221V/E238D/K252Q/Q292K/Q321A/E333D/A345T/N369I/S377Y/T405R/N429G/A436S/T501P/D536E;

K24Q/Q38N/K58Q/V60I/K88Q/Y93H/N97D/R98K/L106S/K125Q/K173Q/K184R/F209I/M212R/N214D/H219D/Y221V/E238D/K252Q/Q292K/Q321A/E333D/A345T/N369I/S377Y/T405R/N429G/A436S/T501P/D536E;

K24Q/Q38N/K58Q/V60I/K88Q/Y93H/N97D/R98K/L106K/K125Q/K173Q/K184R/F209I/M212R/N214D/H219D/Y221V/E238D/K252Q/Q292K/Q321A/E333D/A345T/N369I/S377Y/T405R/N429G/A436S/T501P/D536E;

K24Q/Q38N/T53L/D54A/A55P/E56P/D57P/K58R/V60I/K88Q/Y93H/N97D/R98K/K125Q/K173Q/K184R/F209I/M212R/N214D/H219D/Y221V/E238D/K252Q/Q292K/Q321A/E333D/A345T/N369I/S377Y/T405R/N429G/A436S/T501P/D536E;

K24Q/Q38N/K58Q/V60I/K88Q/Y93H/N97D/R98K/K125Q/M153N/K173Q/K184R/F209I/M212R/N214D/H219D/Y221V/E238D/K252Q/Q292K/Q321A/E333D/A345T/N369I/S377Y/T405R/N429G/A436S/K474T/T501P/D536E;

K24Q/Q38N/K58Q/V60I/K88Q/Y93H/N97D/R98K/K125Q/K173Q/K184R/F209I/M212R/I213S/N214D/H219D/Y221V/E238D/K252Q/Q292K/Q321A/E333D/A345T/N369I/S377Y/T405R/N429G/A436S/T501P/D536E;

K24Q/Q38N/K58Q/V60I/K88Q/Y93H/N97D/R98K/K125Q/K173Q/K184R/F209I/M212R/N214D/H219A/Y221V/E238D/K252Q/Q292K/Q321A/E333D/A345T/N369I/S377Y/T405R/N429G/A436S/T501P/D536E;

K24Q/Q38N/K58Q/V60I/K88Q/Y93H/N97D/R98K/K125Q/K173Q/K184R/Q188R/I189V/P202S/F209I/M212R/N214D/H219D/Y221V/E238D/K252Q/Q292K/Q321A/E333D/A345T/N369I/S377Y/T405R/N429G/A436S/T501P/D536E;

K24Q/Q38N/K58Q/V60I/K88Q/Y93H/N97D/R98K/K125Q/M153N/K173Q/K184R/F209I/M212R/N214D/H219D/Y221V/E238D/K252Q/Q292K/Q321A/E333D/A345T/N369I/S377Y/T405R/N429G/A436S/K474T/T501P/D536E;

K24Q/Q38N/K58Q/V60I/K88Q/Y93H/N97D/R98K/K125Q/H159R/K173Q/K184R/F209I/M212R/N214D/H219D/Y221V/E238D/K252Q/Q292K/Q321A/E333D/A345T/N369I/S377Y/T405R/N429G/A436S/T501P/D536E;

K24Q/Q38N/K58Q/V60I/K88Q/Y93H/N97D/R98K/K125Q/H159K/K173Q/K184R/F209I/M212R/N214D/H219D/Y221V/E238D/K252Q/Q292K/Q321A/E333D/A345T/N369I/S377Y/T405R/N429G/A436S/T501P/D536E;

K24Q/Q38N/K58Q/V60I/K88Q/Y93H/N97D/R98K/K125Q/K173Q/K184R/I189P/F209I/M212R/N214D/H219D/Y221V/E238D/K252Q/Q292K/Q321A/E333D/A345T/N369I/S377Y/T405R/N429G/A436S/T501P/D536E;

K24Q/Q38N/T53L/D54P/A55R/E56F/D57S/K58Q/V60I/K88Q/Y93H/N97D/R98K/K125Q/K173Q/K184R/F209I/M212R/N214D/H219D/Y221V/E238D/K252QQ292K/Q321A/E333D/A345T/N369I/S377Y/T405R/N429G/A436S/T501P/D536E;

K24Q/Q38N/D54A/A55V/E56A/D57Q/K58P/V60I/K88Q/Y93H/N97D/R98K/L106F/K125Q/K173Q/K184R/F209I/M212R/N214D/H219D/Y221V/E238D/K252Q/Q292K/Q321A/E333D/A345T/N369I/S377Y/T405R/N429G/A436S/T501P/D536E;

K24Q/Q38N/T53R/D54A/A55Q/E56T/D57A/K58R/V60I/K88Q/Y93H/N97D/R98K/K125Q/K173Q/K184R/F209I/M212R/N214D/H219D/Y221V/E238D/K252Q/Q292K/Q321A/E333D/A345T/N369I/S377Y/T405R/N429G/A436S/T501P/D536E;

K24Q/Q38N/T53R/D54C/A55V/E56Q/D57P/K58E/V60I/K88Q/Y93H/N97D/R98K/K125Q/K173Q/K184R/F209I/M212R/N214D/H219D/Y221V/E238D/K252Q/Q292K/Q321A/E333D/A345T/N369I/S377Y/T405R/N429G/A436S/T501P/D536E;

K24Q/Q38N/K58Q/V60I/K88Q/Y93H/N97D/R98K/K125Q/R132G/K173Q/K184R/F209I/M212R/N214D/H219D/Y221V/E238D/K252Q/Q292K/Q321A/E333D/A345T/N369I/S377Y/T405R/N429G/A436S/T501P/D536E;

K24Q/Q38N/K58Q/V60I/K88Q/Y93H/N97D/R98K/K125Q/H159Q/K173Q/K184R/F209I/M212R/N214D/H219D/Y221V/E238D/K252Q/Q292K/Q321A/E333D/A345T/N369I/S377Y/T405R/N429G/A436S/T501P/D536E;

K24Q/Q38N/K58Q/V60I/K88Q/Y93H/N97D/R98K/K125Q/M153G/K173Q/K184R/F209I/M212R/N214D/H219D/Y221V/E238D/K252Q/Q292K/Q321A/E333D/A345T/N369I/S377Y/T405R/N429G/A436S/T501P/D536E;

K24Q/Q38N/K58Q/V60I/K88Q/Y93H/N97D/R98K/K125Q/K173Q/K184R/F209I/M212R/N214D/H219D/Y221V/E238D/K252Q/Q292K/Q321A/E333D/A345T/N369I/S377Y/I397V/T405R/N429G/A436S/T501P/D536E;

K24Q/Q38N/K58Q/V60I/K88Q/Y93H/N97D/R98K/K125Q/K173Q/K184R/I189A/F209I/M212R/N214D/H219D/Y221V/E238D/K252Q/Q292K/Q321A/E333D/A345T/N369I/S377Y/T405R/N429G/A436S/T501P/D536E;

K24Q/Q38N/K58Q/V60I/K88Q/Y93H/N97D/R98K/K125Q/K173Q/K184R/F209I/M212R/N214D/H219D/Y221V/E238D/K252Q/Q292K/L310H/E311P/Q321A/E333D/A345T/N369I/S377Y/T405R/N429G/A436S/T501P/D536E;

K24Q/Q38N/K58Q/V60I/K88Q/Y93H/N97D/R98K/K125Q/K173Q/K184R/F209I/M212N/I213Y/N214L/S215R/T216R/S217I/D218P/H219A/L220D/Y221S/E238D/K252Q/P281S/Q292K/L313C/S314T/L315M/T317S/Q321A/E333D/K336R/L337I/A345T/G357R/N369I/S377Y/T405R/N429G/A436S/T501P/D536E;

K24Q/Q38N/K58Q/V60I/K88Q/Y93H/N97D/R98K/Q113R/K125Q/K173Q/K184R/F209I/M212D/I213Y/N214E/S215H/T216Q/D218I/H219L/L220V/Y221Q/E238D/K252Q/P281S/Q292K/L313C/S314T/L315M/T317S/Q321A/E333D/K336R/L337I/A345T/G357R/N369I/S377Y/T405R/N429G/A436S/T501P/D536E;

K24Q/Q38N/K58Q/V60I/K88Q/Y93H/N97D/R98K/K125Q/K173Q/K184R/F209I/M212S/I213L/N214E/S215P/T216P/S217F/D218M/L220P/Y221C/E238D/K252Q/Q292K/L313C/S314T/L315M/T317S/Q321A/E333D/K336R/L337I/A345T/G357R/N369I/S377Y/T405R/N429G/A436S/T501P/D536E;

K24Q/Q38N/K58Q/V60I/K88Q/Y93H/N97D/R98K/K125Q/K173Q/K184R/F209I/M212A/N214Y/S215A/T216R/S217T/D218G/H219R/L220M/Y221N/E238D/K252Q/Q292K/L313C/S314T/L315M/T317S/Q321A/E333D/K336R/L337I/A345T/G357R/N369I/S377Y/T405R/N429G/A436S/T501P/D536E;

K24Q/Q38N/K58Q/V60I/K88Q/Y93H/N97D/R98K/K125Q/K173Q/K184R/F209I/M212N/I213M/N214S/T216Y/S217R/D218G/H219C/L220S/Y221V/E238D/K252Q/P281S/Q292K/L313C/S314T/L315M/T317S/A319T/Q321A/E333D/K336R/L337I/A345T/N369I/S377Y/T405R/N429G/A436S/T501P/D536E;

K24Q/Q38N/K58Q/V60I/K88Q/Y93H/N97D/R98K/K125Q/K173Q/K184R/F209I/M212D/I213A/S215G/T216E/S217K/D218V/H219L/L220S/Y221F/E238D/K252Q/P281S/Q292K/L313C/S314T/L315M/T317S/Q321A/E333D/K336R/L337I/A345T/G357R/N369I/S377Y/T405R/N429G/A436S/T501P/D536E;

K24Q/Q38N/K58Q/V60I/K88Q/Y93H/N97D/R98K/K125Q/K173Q/K184R/F209I/M212S/I213R/N214S/S215K/T216P/S217F/D218C/H219W/L220T/Y221S/E238D/K252Q/Q292K/Q321A/E333D/A345T/N369I/S377Y/T405R/N429G/A436S/T501P/D536E; and K24Q/Q38N/K58Q/V60I/K88Q/Y93H/N97D/R98K/K125Q/K173Q/K184R/F209H/M212R/N214D/H219D/Y221V/E238D/K252Q/P281S/Q292K/L313C/S314T/L315M/T317S/Q321A/E333D/K336R/L337I/A345T/G357R/N369I/S377Y/T405R/N429G/A436S/T501P/D536E, each with numbering relative to positions set forth in SEQ ID NO:2.

Provided herein are nucleic acid molecules having a sequence of nucleic acids set forth in any of SEQ ID NOS: 128-202, 204-288, 693-701, 704-712, 716-722, 754-775 and 800. Also provided herein are nucleic acid molecules having a sequence of nucleic acids having at least 95% sequence identity to a sequence of nucleic acids set forth in any of SEQ ID NOS: 128-202, 204-288, 693-701, 704-712, 716-722, 754-775 and 800. Also provided herein are nucleic acid molecules having a sequence of nucleic acids that are degenerate to a sequence of nucleic acids set forth in any of SEQ ID NOS: 128-202, 204-288, 693-701, 704-712, 716-722, 754-775 and 800. For example, the nucleic acid molecules have a sequence of nucleic acids set forth in any of SEQ ID NOS: 128-202, 204-288, 693-701, 704-712, 716-722, 754-775 and 800.

Provided herein are nucleic acid molecules encoding a modified valencene synthase having a sequence of amino acids set forth in any of SEQ ID NO: 3-66, 68-127, 723-731, 734-742, 746-751, 810-832 and 857. Also provided herein are nucleic acid molecules encoding a modified valencene synthase having a sequence of amino acids that has at least 95% sequence identity to the sequence of amino acids set forth in any of SEQ ID NO: 3-66, 68-127, 723-731, 734-742, 746-751, 810-832 and 857. For example, the nucleic acid molecule encodes a modified valencene synthase that has a sequence of amino acids set forth in any of SEQ ID NO: 3-66, 68-127, 723-731, 734-742, 746-751, 810-832 and 857.

Also provided herein are nucleic acid molecules encoding modified valencene polypeptides that contain one or more heterologous domains or portions thereof from one or more terpene synthases, wherein the domain is an unstructured loop 1; alpha helix 1; unstructured loop 2; alpha helix 2; unstructured loop 3; alpha helix 3; unstructured loop 4; alpha helix 4; unstructured loop 5; alpha helix 5; unstructured loop 6; alpha helix 6; unstructured loop 7; alpha helix 7; unstructured loop 8; alpha helix 8; unstructured loop 9; alpha helix A; A-C loop; alpha helix C; unstructured loop 11; alpha helix D; unstructured loop 12; alpha helix D1; unstructured loop 13; alpha helix D2; unstructured loop 14; alpha helix E; unstructured loop 15; alpha helix F; unstructured loop 16; alpha helix G1; unstructured loop 17; alpha helix G2; unstructured loop 18; alpha helix H1; unstructured loop 19; alpha helix H2; unstructured loop 20; alpha helix H3; unstructured loop 21; alpha helix a-1; unstructured loop 22; alpha helix I; unstructured loop 23; alpha helix J; J-K loop; alpha helix K; and/or unstructured loop 25.

Also provided herein are nucleic acid molecules encoding a modified valencene polypeptide that contains one or more heterologous domains or portions thereof from one or more terpene synthases. For example, the one or more heterologous domain can be selected from among unstructured loop 1; alpha helix 1; unstructured loop 2; alpha helix 2; unstructured loop 3; alpha helix 3; unstructured loop 4; alpha helix 4; unstructured loop 5; alpha helix 5; unstructured loop 6; alpha helix 6; unstructured loop 7; alpha helix 7; unstructured loop 8; alpha helix 8; unstructured loop 9; alpha helix A; A-C loop; alpha helix C; unstructured loop 11; alpha helix D; unstructured loop 12; alpha helix D1; unstructured loop 13; alpha helix D2; unstructured loop 14; alpha helix E; unstructured loop 15; alpha helix F; unstructured loop 16; alpha helix G1; unstructured loop 17; alpha helix G2; unstructured loop 18; alpha helix H1; unstructured loop 19; alpha helix H2; unstructured loop 20; alpha helix H3; unstructured loop 21; alpha helix a-1; unstructured loop 22; alpha helix I; unstructured loop 23; alpha helix J; J-K loop; alpha helix K; and/or unstructured loop 25. In some examples, the heterologous domain or a contiguous portion thereof replaces all or a contiguous portion of the corresponding native domain of the valencene synthase not containing the heterologous domain. In other examples, the encoded modified valencene synthase contains all of a heterologous domain of a different terpene synthase. Also provided herein are nucleic acid molecules encoding a modified valencene polypeptide that contains at least 50%, 60%, 70%, 80%, 90%, or 95% of contiguous amino acids of a heterologous domain from one or more terpene synthases.

In one embodiment, the modified valencene synthase polypeptide encoded by the nucleic acid molecule contains a heterologous domain that is all or a contiguous portion of the unstructured loop 2 domain. For example, the encoded modified valencene synthase polypeptide contains a heterologous unstructured loop 2 domain or contiguous portion thereof, whereby the native unstructured loop 2 domain corresponding to amino acids residues 53-58 of the valencene synthase polypeptide set forth in SEQ ID NO:2 is replaced with all or a portion of the corresponding region from a different terpene synthase. In another embodiment, the modified valencene synthase polypeptide encoded by the nucleic acid molecule contains a heterologous domain that is all or a contiguous portion of the alpha helix 3 domain. For example, the encoded modified valencene synthase polypeptide contains a heterologous alpha helix 3 domain or contiguous portion thereof, whereby the native alpha helix 3 domain corresponding to amino acids residues 79-93 of the valencene synthase polypeptide set forth in SEQ ID NO:2 is replaced with all or a portion of the corresponding region from a different terpene synthase. In a further embodiment, the modified valencene synthase polypeptide encoded by the nucleic acid molecule contains a heterologous domain that is all of a contiguous portion of the unstructured loop 5 domain. For example, the encoded modified valencene synthase polypeptide contains an unstructured loop 5 domain or contiguous portion thereof, whereby the native unstructured loop 5 domain corresponding to amino acid residues 115-141 of the valencene synthase polypeptide set forth in SEQ ID NO:2 is replaced with all or a portion of the corresponding region from a different terpene synthase.

In yet another embodiment, the modified valencene synthase polypeptide encoded by the nucleic acid molecule contains a heterologous domain that is all or a contiguous portion of the unstructured loop 6 domain. For example, the encoded modified valencene synthase polypeptide contains a heterologous unstructured loop 6 domain or contiguous portion thereof, whereby the native unstructured loop 6 domain corresponding to amino acids residues 153-162 of the valencene synthase polypeptide set forth in SEQ ID NO:2 is replaced with all or a portion of the corresponding region from a different terpene synthase. In one embodiment, the modified valencene synthase polypeptide encoded by the nucleic acid molecule contains a heterologous domain that is all or a contiguous portion of the unstructured loop 7 domain. For example, the encoded modified valencene synthase polypeptide contains a heterologous unstructured loop 7 domain or contiguous portion thereof, whereby the native unstructured loop 7 domain corresponding to amino acids residues 174-184 of the valencene synthase polypeptide set forth in SEQ ID NO:2 is replaced with all or a portion of the corresponding region from a different terpene synthase.

In another embodiment, the modified valencene synthase polypeptide encoded by the nucleic acid molecule contains a heterologous domain that is all or a contiguous portion of the unstructured loop 9 domain. For example, the encoded modified valencene synthase polypeptide contains a heterologous unstructured loop 9 domain or contiguous portion thereof, whereby the native unstructured loop 9 domain corresponding to amino acids residues 213-222 of the valencene synthase polypeptide set forth in SEQ ID NO:2 is replaced with all or a portion of the corresponding region from a different terpene synthase. In another embodiment, the modified valencene synthase polypeptide encoded by the nucleic acid molecule contains a heterologous domain that is all or a contiguous portion of the alpha helix D1 domain. For example, the encoded modified valencene synthase polypeptide contains a heterologous alpha helix D1 domain or contiguous portion thereof, whereby the native alpha helix D1 domain corresponding to amino acids residues 310-322 of the valencene synthase polypeptide set forth in SEQ ID NO:2 is replaced with all or a portion of the corresponding region from a different terpene synthase.

In yet another embodiment, the modified valencene synthase polypeptide encoded by the nucleic acid molecule contains a heterologous domain that is all or a contiguous portion of the J-K loop domain. For example, the encoded modified valencene synthase polypeptide contains a heterologous J-K loop domain or contiguous portion thereof, whereby the native J-K loop domain corresponding to amino acids residues 522-534 of the valencene synthase polypeptide set forth in SEQ ID NO:2 is replaced with all or a portion of the corresponding region from a different terpene synthase. In another embodiment, the modified valencene synthase polypeptide encoded by the nucleic acid molecule contains a heterologous domain that is all or a contiguous portion of the unstructured loop 1 domain. For example, the encoded modified valencene synthase polypeptide contains a heterologous unstructured loop 1 domain or contiguous portion thereof, whereby the native unstructured loop 1 domain corresponding to amino acid residues 1-29 of the valencene synthase polypeptide set forth in SEQ ID NO:2 is replaced with all or a portion of the corresponding region from a different terpene synthase.

In yet another embodiment, the modified valencene synthase polypeptide encoded by the nucleic acid molecule contains a heterologous domain that is all or a contiguous portion of the alpha helix 1 domain. For example, the encoded modified valencene synthase polypeptide contains a heterologous alpha helix 1 domain or contiguous portion thereof, whereby the native alpha helix 1 domain corresponding to amino acid residues 30-39 and 44-52 of SEQ ID NO:2 is replaced with all or a contiguous portion of the corresponding region from a different terpene synthase. In a further embodiment, the modified valencene synthase polypeptide encoded by the nucleic acid molecule contains a heterologous domain that is all or a contiguous portion of the unstructured loop 4 domain. For example, the encoded modified valencene synthase polypeptide contains a heterologous unstructured loop 4 domain or contiguous portion thereof, whereby the native unstructured loop 4 domain corresponding to amino acid residues 94-100 of SEQ ID NO:2 is replaced with all or a contiguous portion of the corresponding region from a different terpene synthase.

Provided herein are nucleic acid molecules encoding a modified valencene polypeptide that contains one or more heterologous domains or portions thereof from one or more terpene synthases wherein the different terpene synthase is a terpene synthase set forth in Table 5B. In one example, the different terpene synthase is selected from among *Vitis vinifera* valencene synthase, tobacco epi-aristolochene synthase (TEAS) and *Hyoscyamus muticus* premnaspirodiene synthase (HPS).

In one embodiment, the encoded modified valencene synthase polypeptide has a heterologous unstructured loop 2 domain or a contiguous portion thereof, whereby amino acids residues corresponding to positions 53-58 of the valencene synthase polypeptide set forth in SEQ ID NO:2 are replaced with amino acids residues 58-63 of the TEAS polypeptide set forth in SEQ ID NO:295 or 941. In another embodiment, the encoded modified valencene synthase polypeptide comprises a heterologous alpha helix 3 domain or a contiguous portion thereof and a heterologous unstructured loop 4 domain or contiguous portion thereof, whereby amino acids residues corresponding to positions 85-89 of the valencene synthase polypeptide set forth in SEQ ID NO:2 are replaced with amino acid residues 93-97 of the HPS polypeptide set forth in SEQ ID NO:942. In yet another embodiment, the encoded modified valencene synthase polypeptide contains a heterologous alpha helix 3 domain or a contiguous portion thereof and a heterologous unstructured loop 4 domain or a contiguous portion thereof, whereby amino acids residues corresponding to positions 85-99 of the valencene synthase polypeptide set forth in SEQ ID NO:2 are replaced with amino acid residues 96-112 of the *Vitis vinifera* valencene synthase set forth in SEQ ID NO:346. In a further embodiment, the encoded modified valencene synthase polypeptide contains a heterologous unstructured loop 5 domain or a contiguous portion thereof, whereby amino acid residues at positions corresponding to positions 115-146 of the valencene synthase polypeptide are replaced with amino acid residues 128-129 of the *Vitis vinifera* valencene synthase set forth in SEQ ID NO:346.

In a further embodiment, the encoded modified valencene synthase polypeptide comprises a heterologous unstructured loop 7 domain or a contiguous portion thereof, whereby amino acids residues at positions corresponding to positions 174-184 of the valencene synthase polypeptide set forth in SEQ ID NO:2 are replaced with amino acid residues 185-193 of the HPS polypeptide set forth in SEQ ID NO:942. In another embodiment, the encoded modified valencene synthase polypeptide comprises a heterologous loop 9 domain or a contiguous portion thereof, whereby amino acids residues at positions corresponding to positions 212-221 of the valencene synthase polypeptide set forth in SEQ ID NO:2 are replaced with amino acid residues 221-228 of the HPS polypeptide set forth in SEQ ID NO:942. In yet another embodiment, the encoded modified valencene synthase polypeptide comprises a heterologous loop 9 domain or a contiguous portion thereof, whereby amino acid residues at positions corresponding to positions 212-221 of the valencene synthase polypeptide set forth in SEQ ID NO:2 are replaced with amino acid residues 213-221 of the TEAS polypeptide set forth in SEQ ID NO:295.

In one embodiment, the encoded modified valencene synthase polypeptide comprises a heterologous unstructured loop 9 domain or a contiguous portion thereof, whereby amino acid residues at positions corresponding to positions 212-221 of the valencene synthase polypeptide set forth in SEQ ID NO:2 are replaced with amino acid residues 223-230 of the *Vitis vinifera* valencene synthase set forth in SEQ ID NO:346. In another embodiment, the encoded modified valencene synthase polypeptide comprises a heterologous unstructured loop 1 domain or a contiguous portion thereof and a heterologous alpha helix 1 domain or a contiguous portion thereof, whereby amino acid residues at positions corresponding to position 3-41 of the valencene synthase polypeptide set forth in SEQ ID NO:2 are replaced with amino acid residues 3-51 of the *Vitis vinifera* valencene synthase set forth in SEQ ID NO:346. In yet another embodiment, the encoded modified valencene synthase polypeptide comprises a heterologous unstructured loop 6 domain or a contiguous portion thereof, whereby amino acids residues at positions corresponding to positions 152-163 of the valencene synthase polypeptide set forth in SEQ ID NO:2 are replaced with amino acid residues 163-174 of the HPS polypeptide set forth in SEQ ID NO:942.

In one embodiment, the encoded modified valencene synthase polypeptide comprises a heterologous alpha helix D1 domain or contiguous portion thereof, whereby amino acids residues at positions corresponding to positions 310-322 of the valencene synthase polypeptide set forth in SEQ ID NO:2 are replaced with amino acid residues 317-329 of the HPS polypeptide set forth in SEQ ID NO:942. In another embodiment, the encoded modified valencene synthase polypeptide comprises a heterologous J-K loop domain or a contiguous portion thereof, whereby amino acids residues at positions corresponding to positions 522-534 of the valencene synthase polypeptide set forth in SEQ ID NO:2 are replaced with amino acid residues 527-541 of the HPS polypeptide set forth in SEQ ID NO:942.

Among the nucleic acid molecules provided herein are those that encode modified valencene synthase polypeptides that contains replacements selected from among modifications corresponding to:

K24Q/Q38N/T53L/D54A/A55T/E56G/D57R/V60I/K88Q/Y93H/N97D/R98K/K125Q/K173Q/K184R/F209I/M212R/N214D/H219D/Y221V/E238D/K252Q/Q292K/Q321A/E333D/A345T/N369I/S377Y/T405R/N429G/A436S/T501P/D536E;

K24Q/Q38N/T53L/D54A/A55T/E56G/D57R/V60I/K88Q/Y93H/N97D/R98K/K125Q/K173Q/K184R/F209I/M212R/N214D/H219D/Y221V/E238D/K252Q/P281S/Q292K/L313C/S314T/L315M/T317S/Q321A/E333D/K336R/L337I/A345T/N347L/G357R/N369I/S377Y/T405R/N429G/A436S/T501P/D536E;

K24Q/Q38N/T53L/D54A/A55T/E56G/D57R/V60I/K88Q/Y93H/N97D/R98K/K125Q/K173Q/K184R/F209I/M212R/N214D/H219D/Y221V/E238D/K252Q/P281S/Q292K/L313C/S314T/L315M/T317S/Q321A/E333D/K336R/L337I/A345T/G357R/N369I/S377Y/T405R/N429G/A436S/T501P/D536E;

K24Q/Q38N/K58Q/V60I/K88Q/Y93H/N97D/R98K/K125Q/K173Q/L175→ - - - /V176→ - - - /Q178→A176/D179→P177/V181→L179/T182→K180/P183→S181/K184→P182/F209→I207/M212→R210/N214→D212/H219→D217/Y221→V219/E238→D236/K252→Q250/P281→S279/Q292→K290/L313→C311/S314→T312/L315→M313/T317→S315/Q321→A319/E333→D331/K336→R334/L337→I335/A345→T343/G357→R355/N369→I367/S377→Y375/T405→R403/N429→G427/A436→S434/T501→P499/D536→E534;

S2R/S3D/G4K/E5G/F7C/K24Q/Q38N/K58Q/V60I/K88Q/Y93H/N97D/R98K/K125Q/K173Q/L175→ - - - /V176→ - - - /Q178→A176/D179→P177/V181→L179/T182→K180/P183→S181/K184→P182/F209→I207/M212→R210/N214→D212/H219→D217/Y221→V219/E238→D236/K252→Q250/P281→S279/Q292→K290/L313→C311/S314→T312/L315→M313/T317→S315/Q321→A319/E333→D331/K336→R334/L337→I335/A345→T343/G357→R355/N369→I367/S377→Y375/T405→R403/N429→G427/A436→S434/E484→D482/T501→P499/D536→E534;

K24Q/Q38N/T53L/D54A/A55T/E56G/D57R/V60I/A85M/I86L/Q87D/K88H/L89I/C90Y/ - - - →R91/ - - - →A92/ - - - →D93/I92→Y95/Y93→F96/I94→E97/D95→A98/S96→H99/N97→E100/R98→Y101/A99→N102/L111→S114/K125→Q128/K173→Q176/L175→ - - - /V176→ - - - /Q178→A179/D179→P180/V181→L182/T182→K183/P183→S184/K184→P185/F209→I210/M212→R213/N214→D215/H219→D220/Y221→V222/E238→D239/K252→Q253/P281→S282/Q292→K293/L313→C314/S314→T315/L315→M316/T317→S318/Q321→A322/E333→D334/K336→R337/L337→I338/A345→T346/G357→R358/N369→I370/S377→Y378/T405→R406/N429→G430/A436→S437/E484→D485/T501→P502/D536→E537;

R19K/K24Q/Q38N/T53L/D54A/A55T/E56G/D57R/V60I/A85M/I86L/Q87D/K88H/L89I/C90Y/ - - - →R91/ - - - →A92 - - - →D93/I92→Y95/Y93→F96/I94→E97/D95→A98/S96→H99/N97→E100/R98→Y101/A99→N102/K125→Q128/K173→Q176/L175→ - - - /V176→ - - - /Q178→A179/D179→P180/V181→L182/T182→K183/P183→S184/K184→P185/F209→I210/M212→R213/N214→D215/H219→D220/Y221→V222/E238→D239/K252→Q253/P281→S282/Q292→K293/L313→C314/S314→T315/L315→M316/T317→S318/Q321→A322/E333→D334/K336→R337/L337→I338/A345→T346/G357→R358/N369→I370/S377→Y378/T405→R406/N429→G430/A436→S437/E484→D485/T501→P502/D536→E537;

K24Q/Q38N/T53L/D54A/A55T/E56G/D57R/V60I/A85M/I86L/Q87D/K88H/L89I/C90Y/ - - - →R91/ - - - →

A92/ - - - →D93/I92→Y95/Y93→F96/I94→E97/D95→A98/S96→H99/N97→E100/R98→Y101/A99→N102/K125→Q128/K173→Q176/L175→ - - - /V176→ - - - /Q178→A179/D179→P180N181→L182/T182→K183/P183→S184/K184→P185/F209→I210/M212→R213/N214→D215/H219→D220/Y221→V222/E238→D239/K252→Q253/P281→S282/Q292→K293/L313→C314/S314→T315/L315→M316/T317→S318/Q321→A322/E333→D334/K336→R337/L337→I338/A345→T346/G357→R358/N369→I370/S377→Y378/T405→R406/N429→G430/A436→S437/E484→D485/T501→P502/D536→E537;

K24Q/Q38N/K58Q/V60I/K88Q/Y93H/N97D/R98K/K125Q/K173Q/K184R/F209I/M212I/I213Y/N214E/S215→ - - - /T216→ - - - /S217→E215/D218→E216/H219→G217/L220→F218/Y221→K219/E238→D236/K252→Q250/P281→S279/Q292→K290/L313→C311/S314→T312/L315→M313/T317→S315/Q321→A319/E333→D331/K336→R334/L337→I335/A345→T343/G357→R355/N369→I367/S377→Y375/T405→R403/N429→G427/A436→S434/T501→P499/D536→E534;

R19K/K24Q/Q38N/T53L/D54A/A55T/E56G/D57R/V60I/A85M/I86L/Q87D/K88H/L89I/C90Y/ - - - →R91/ - - - →A92/ - - - →D93/I92→Y95/Y93→F96/I94→E97/D95→A98/S96→H99/N97→E100/R98→Y101/A99→N102/K125→Q128/K173→Q176/L175→ - - - /V176→ - - - /Q178→A179/D179→P180N181→L182/T182→K183/P183→S184/K184→P185/F209→I210/M212→S213/N214→Y215/S215→D216/T216→K217/S217 - - - /D218E/H219Q/L220S/Y221K/E238D/K252Q/P281S/Q292K/L313C/S314T/L315M/T317S/Q321A/E333D/K336R/L337I/A345T/G357R/N369I/S377Y/T405R/N429G/A436S/E484D/T501P/D536ER19K/K24Q/Q38N/T53L/D54A/A55T/E56G/D57R/V60I/A85M/I86L/Q87D/K88H/L89I/C90Y/ - - - →R91/ - - - →A92/ - - - →D93/I92→Y95/Y93→F96/I94→E97/D95→A98/S96→H99/N97→E100/R98→Y101/A99→N102/K125→Q128/K173→Q176/L175→ - - - /V176→ - - - /Q178→A179/D179→P180/V181→L182/T182→K183/P183→S184/K184→P185/F209→I210/M212→S213/N214→Y215/S215→D216/T216→K217/S217 - - - /D218E/H219Q/L220S/Y221K/E238D/K252Q/P281S/Q292K/L313C/S314T/L315M/T317 S/Q321A/I325T/E333D/K336R/L337I/A345T/G357R/N369I/S377Y/T405R/N429G/A436S/E484D/T501P/D536E;

R19K/K24Q/Q38N/T53L/D54A/A55T/E56G/D57R/V60I/A85M/I86L/Q87D/K88H/L89I/C90Y/ - - - →R91/ - - - →A92/ - - - →D93/I92→Y95/Y93→F96/I94→E97/D95→A98/S96→H99/N97→E100/R98→Y101/A99→N102/K125→Q128/K173→Q176/L175→ - - - /V176→ - - - /Q178→A179/D179→P180/V181→L182/T182→K183/P183→S184/K184→P185/F209→I210/M212→V213/I213→Y214/N214→ - - - /S215→ - - - /T216→Q215/S217→D216/D218→E217/H219→A218/L220→F219/Y221→H220/E238→D237/K252→Q251/P281→S280/Q292→K291/L313→C312/S314→T313/L315→M314/T317→S316/Q321→A320/E333→D332/K336→R335/L337→I336/A345→T344/G357→R356/N369→I368/S377→Y376/T405→R404/N429→G428/A436→S435/E484→D483/T501→P500/D536→E535/

R19K/K24Q/Q38N/T53L/D54A/A55T/E56G/D57R/V60I/A85M/I86L/Q87D/K88H/L89I/C90Y/ - - - →R91/ - - - →A92/ - - - →D93/I92→Y95/Y93→F96/I94→E97/D95→A98/S96→H99/N97→E100/R98→Y101/A99→N102/K125→Q128/K173→Q176/L175→ - - - /V176→ - - - /Q178→A179/D179→P180/V181→L182/T182→K183/P183→S184/K184→P185/F209→I210/M212→Y213/I213→S214/N214→P215/S215→N216/T216→V217/S217→I218/H219→L220/L220→A221/Y221→P222/E238→D239/K252→Q253/Q292→K293/Q321→A322/E333→D334/A345→T346/N369→I370/S377→Y378/T405→R406/N429→G430/A436→S437/T501→P502/D536→E537;

R19K/K24Q/Q38N/T53L/D54A/A55T/E56G/D57R/V60I/A85M/I86L/Q87D/K88H/L89I/C90Y/ - - - →R91/ - - - →A92/ - - - →D93/I92→Y95/Y93→F96/I94→E97/D95→A98/S96→H99/N97→E100/R98→Y101/A99→N102/K125→Q128/K173→Q176/L175→ - - - /V176→ - - - /Q178→A179/D179→P180/V181→L182/T182→K183/P183→S184/K184→P185/F209→I210/M212→K213/I211→P214/N214→V215/S215→T216/T216→R217/D218→L219/H219→S220/L220→A221/Y221→L222/E238→D239/K252→Q253/Q292→K293/V320→A321/Q321→A322/E333→D334/A345→T346/N369→I370/S377→Y378/T405→R406/N429→G430/A436→S437/T501→P502/D536→E537;

R19K/K24Q/Q38N/T53L/D54A/A55T/E56G/D57R/V60I/A85M/I86L/Q87D/K88H/L89I/C90Y/ - - - →R91/ - - - →A92/ - - - →D93/I92→Y95/Y93→F96/I94→E97/D95→A98/S96→H99/N97→E100/R98→Y101/A99→N102/K125→Q128/K173→Q176/L175→ - - - /V176→ - - - /Q178→A179/D179→P180/V181→L182/T182→K183/P183→S184/K184→P185/F209→I210/I213→Q214/N214→H215/S215→L216/T216→C217/S217→F218/D218→S219/H219→R220/L220→H221/Y221→K222/E238→D239/K252→Q253/Q292→K293/Q321→A322/E333→D334/A345→T346/N369→I370/S377→Y378/T405→R406/N429→G430/A436→S437/T501→P502/D536→E537;

R19K/K24Q/Q38N/T53L/D54A/A55T/E56G/D57R/V60I/A85M/I86L/Q87D/K88H/L89I/C90Y/ - - - →R91/ - - - →A92/ - - - →/D93/I92→Y95/Y93→F96/I94→E97/D95→A98/S96→H99/N97→E100/R98→Y101/A99→N102/K125→Q128/K173→Q176/L175→ - - - /V176→ - - - /Q178→A179/D179→P180/V181→L182/T182→K183/P183→S184/K184→P185/F209→I210/M212→F213/I213→N214/N214→C215/S215→V216/T216→K217/S217→Y218/D218→Y219/H219→F220/L220→T221/Y221→Q222/E238→D239/K252→Q253/Q292→K293/Q321→A322/E333→D334/A345→T346/N369→I370/S377→Y378/T405→R406/N429→G430/A436→S437/T501→P502/D536→E537;

R19K/K24Q/Q38N/T53L/D54A/A55T/E56G/D57R/V60I/A85M/I86L/Q87D/K88H/L89I/C90Y/ - - - →R91/ - - - →92/ - - - →D93/I92→Y95/Y93→F96/I94→E97/D95→A98/S96→H99/N97→E100/R98→Y101/A99→N102/K125→Q128/K173→Q176/L175→ - - - /V176→ - - - /Q178→A179/D179→P180/V181→L182/T182→K183/P183→S184/K184→P185/F209→I210/M212→Y213/I213→R214/N214→L215/S215→N216/T216→D217/S217→N218/D218→Y219/H219→A220/L220→E221/Y221→W222/E238→D239/K252→Q253/Q292→K293/Q321→A322/E333→D334/A345→T346/N369→I370/S377→Y378/T405→R406/N429→G430/A436→S437/T501→P502/D536→E537;

K24Q/D28G/Q38N/T53L/D54A/A55T/E56G/D57R/V60I/K62R/A85M/I86L/Q87D/K88H/L89I/C90Y/ - - - →R91/ - - - →A92/ - - - →D93/I92→Y95/Y93→F96/I94→E97/D95→A98/S96→H99/N97→E100/R98→Y101/A99→N102/K125→Q128/K173→Q176/L175→ - - - /V176→ - - - /Q178→A179/D179→P180/V181→L182/T182→K183/P183→S184/K184→P185/F209→I210/M212→S213/I213→K214/N214→A215/S215→Q216/T216→A217/S217→H218/D218→S219/H219→L220/

L220→V221/Y221→S222/E238→D239/K252→Q253/Q292→K293/Q321→A322/E333→D334/A345→T346/N369→I370/S377→Y378/T405→R406/N429→G430/A436→S437/T501→P502/D536→E537;

K24Q/Q38N/T53L/D54A/A55T/E56G/D57R/V60I/K62R/A85M/I86L/Q87D/K88H/L89I/C90Y/ - - - →R91/ - - - →A92/ - - - →D93/I92→Y95/Y93→F96/I94→E97/D95→A98/S96→H99/N97→E100/R98→Y101/A99→N102/K125→Q128/K173→Q176/L175→ - - - /V176→ - - - /Q178→A179/D179→P180/V181→L182/T182→K183/P183→S184/K184→P185/F209→I210/M212→S213/I213→L214/N214→V215/S215→R216/T216→S217/S217→E218/D218→K219/H219→D220/L220→P221/Y221→N222/E238→D239/K252→Q253/Q292→K293/Q321→A322/E333→D334/A345→T346/N369→I370/S377→Y378/T405→R406/N429→G430/A436→S437/T501→P502/D536→E537;

R19K/K24Q/Q38N/T53L/D54A/A55T/E56G/D57R/V60I/A85M/I86L/Q87D/K88H/L89I/C90Y/ - - - →R91/ - - - →A92/ - - - →D93/I92→Y95/Y93→F96/I94→E97/D95→A98/S96→H99/N97→E100/R98→Y101/A99→N102/K125→Q128/K173→Q176/L175→ - - - /V176→ - - - /Q178→A179/D179→P180/V181→L182/T182→K183/P183→S184/K184→P185/F209→I210/M212→H213/I213→R214/N214→T215/S215→P216/T216→A217/S217→F218/D218→C219/H219→R220/L220→G221/Y221→E222/E238→D239/K252→Q253/Q292→K293/Q321→A322/E333→D334/A345→T346/N369→I370/S377→Y378/T405→R406/N429→G430/A436→S437/T501→P502/D536→E537;

R19K/K24Q/Q38N/T53L/D54A/A55T/E56G/D57R/V60I/A85M/I86L/Q87D/K88H/L89I/C90Y/ - - - →R91/ - - - →A92/ - - - →D93/I92→Y95/Y93→F96/I94→E97/D95→A98/S96→H99/N97→E100/R98→Y101/A99→N102/K125→Q128/K173→Q176/L175→ - - - /V176→ - - - /Q178→A179/D179→P180/V181→L182/T182→K183/P183→S184/K184→P185/F209→I210/M212→Q213/I213→V214/N214→R215/S215→K216/T216→R217/S217→C218/D218→V219/H219→E220/L220→A221/Y221→V222/E238→D239/K252→Q253/Q292→K293/Q321→A322/E333→D334/A345→T346/N369→I370/S377→Y378/T405→R406/N429→G430/A436→S437/T501→P502/D536→E537;

R19K/K24Q/Q38N/T53L/D54A/A55T/E56G/D57R/V60I/A85M/I86L/Q87D/K88H/L89I/C90Y/ - - - →R91/ - - - →A92/ - - - →D93/I92→Y95/Y93→F96/I94→E97/D95→A98/S96→H99/N97→E100/R98→Y101/A99→N102/K125→Q128/K173→Q176/L175→ - - - /V176→ - - - /Q178→A179/D179→P180/V181→L182/T182→K183/P183→S184/K184→P185/F209→I210/M212→V213/I213→Y214/N214→ - - - /S215→ - - - /T216→Q215/S217→D216/D218→E217/H219→A218/L220→F219/Y221→H220/E238→D237/K252→Q251/P281→S280/Q292→K291/L313→C312/S314→T313/L315→M314/T317→S316/Q321→A320/E333→D332/K336→R335/L337→I336/A345→T344/G357→R356/N369→I368/S377→Y376/T405→R404/N429→G428/A436→S435/Q448→L447/E484→D483/T501→P500/D536→E535;

S2Q/S3T/G4F/E5N/T6C/F7A/R19K/K24Q/Q38N/T53L/D54A/A55T/E56G/D57R/V60I/A85M/I86L/Q87D/K88H/L89I/C90Y/ - - - →R91/ - - - →A92 - - - →D93/I92→Y95/Y93→F96/I94→E97/D95→A98/S96→H99/N97→E100/R98→Y101/A99→N102/K125→Q128/K173→Q176/L175→ - - - /V176→ - - - /Q178→A179/D179→P180/V181→L182/T182→K183/P183→S184/K184→P185/F209→I210/M212→S213/N214→Y215/S215→D216/T216→K217/S217 - - - /D218E/H219Q/L220S/Y221K/E238D/K252Q/P281S/Q292K/L313C/S314T/L315M/T317S/Q321A/E333D/K336R/L337I/A345T/G357R/N369I/S377Y/T405R/N429G/A436S/E484D/T501P/D536E;

S2A/S3G/G4R/E5G/T6A/F7S/R19K/K24Q/Q38N/T53L/D54A/A55T/E56G/D57R/V60I/A85M/I86L/Q87D/K88H/L89I/C90Y/ - - - →R91/ - - - →A92/ - - - →D93/I92→Y95/Y93→F96/I94→E97/D95→A98/S96→H99/N97→E100/R98→Y101/A99→N102/K125→Q128/K173→Q176/L175→ - - - /V176→ - - - /Q178→A179/D179→P180/V181→L182/T182→K183/P183→S184/K184→P185/F209→I210/M212→S213/N214→Y215/S215→D216/T216→K217/S217 - - - /D218E/H219Q/L220S/Y221K/E238D/K252Q/P281S/Q292K/L313C/S314T/L315M/T317S/Q321A/E333D/K336R/L337I/A345T/G357R/N369I/S377Y/T405R/N429G/A436S/E484D/T501P/D536E;

S2V/S3L/G4K/E5S/T6K/F7R/R19K/K24Q/Q38N/T53L/D54A/A55T/E56G/D57R/V60I/A85M/I86L/Q87D/K88H/L89I/C90Y/ - - - →R91/ - - - →A92/ - - - →D93/I92→Y95/Y93→F96/I94→E97/D95→A98/S96→H99/N97→E100/R98→Y101/A99→N102/K125→Q128/K173→Q176/L175→ - - - /V176→ - - - /Q178→A179/D179→P180/V181→L182/T182→K183/P183→S184/K184→P185/F209→I210/M212→S213/N214→Y215/S215→D216/T216→K217/S217 - - - /D218E/H219Q/L220S/Y221K/E238D/K252Q/P281S/Q292K/L313C/S314T/L315M/T317S/Q321A/E333D/K336R/L337I/A345T/G357R/N369I/S377Y/T405R/N429G/A436S/E484D/T501P/D536E;

S2K/S3E/G4C/E5T/T6M/F7L/R19K/K24Q/Q38N/T53L/D54A/A55T/E56G/D57R/V60I/A85M/I86L/Q87D/K88H/L89I/C90Y/ - - - →R91/ - - - →A92/ - - - →D93/I92→Y95/Y93→F96/I94→E97/D95→A98/S96→H99/N97→E100/R98→Y101/A99→N102/K125→Q128/K173→Q176/L175→ - - - /V176→ - - - /Q178→A179/D179→P180/V181→L182/T182→K183/P183→S184/K184→P185/F209→I210/M212→S213/N214→Y215/S215→D216/T216→K217/S217 - - - /D218E/H219Q/L220S/Y221K/E238D/K252Q/P281S/Q292K/L313C/S314T/L315M/T317S/Q321A/E333D/K336R/L337I/A345T/G357R/N369I/S377Y/T405R/N429G/A436S/E484D/T501P/D536E;

S2P/R19K/K24Q/Q38N/T53L/D54A/A55T/E56G/D57R/V60I/A85M/I86L/Q87D/K88H/L89I/C90Y/ - - - →R91/ - - - →A92/ - - - →D93/I92→Y95/Y93→F96/I94→E97/D95→A98/S96→H99/N97→E100/R98→Y101/A99→N102/K125→Q128/K173→Q176/L175→ - - - /V176→ - - - /Q178→A179/D179→P180/V181→L182/T182→K183/P183→S184/K184→P185/F209→I210/M212→S213/N214→Y215/S215→D216/T216→K217/S217 - - - /D218E/H219Q/L220S/Y221K/E238D/K252Q/P281S/Q292K/L313C/S314T/L315M/T317S/Q321A/E333D/K336R/L337I/A345T/G357R/N369I/S377Y/T405R/N429G/A436S/E484D/T501P/D536E;

S2C/S3M/G4T/E5G/T6E/F7S/R19K/K24Q/Q38N/T53L/D54A/A55T/E56G/D57R/V60I/A85M/I86L/Q87D/K88H/L89I/C90Y/ - - - →R91/ - - - →A92/ - - - →D93/I92→Y95/Y93→F96/I94→E97/D95→A98/S96→H99/N97→E100/R98→Y101/A99→N102/K125→Q128/K173→Q176/L175→ - - - /V176→ - - - /Q178→A179/D179→P180/V181→L182/T182→K183/P183→S184/K184→P185/F209→I210/M212→S213/N214→Y215/S215→D216/T216→K217/S217 - - - /D218E/H219Q/L220S/Y221K/E238D/K252Q/P281S/Q292K/L313C/S314T/L315M/

T317S/Q321A/E333D/K336R/L337I/A345T/G357R/N369I/S377Y/T405R/N429G/A436S/E484D/T501P/D536E;

S2Q/S3N/G4L/E5G/T6Y/F7S/R19K/K24Q/Q38N/T53L/D54A/A55T/E56G/D57R/V60I/A85M/I86L/Q87D/K88H/L89I/C90Y/- - -→R91/- - -→A92/- - -→D93/I92→Y95/Y93→F96/I94→E97/D95→A98/S96→H99/N97→E100/R98→Y101/A99→N102/K125→Q128/K173→Q176/L175→ - - - /V176→ - - - /Q178→A179/D179→P180/V181→L182/T182→K183/P183→S184/K184→P185/F209→I210/M212→S213/N214→Y215/S215→D216/T216→K217/S217 - - - /D218E/H219Q/L220S/Y221K/E238D/K252Q/P281S/Q292K/L313C/S314T/L315M/T317S/Q321A/E333D/K336R/L337I/A345T/G357R/N369I/S377Y/T405R/N429G/A436S/E484D/T501P/D536E;

S2L/S3N/G4S/E5I/T6D/F7S/R19K/K24Q/Q38N/T53L/D54A/A55T/E56G/D57R/V60I/A85M/I86L/Q87D/K88H/L89I/C90Y/- - -→R91/- - -→A92/- - -→D93/I92→Y95/Y93→F96/I94→E97/D95→A98/S96→H99/N97→E100/R98→Y101/A99→N102/K125→Q128/K173→Q176/L175→ - - - /V176→ - - - /Q178→A179/D179→P180/V181→L182/T182→K183/P183→S184/K184→P185/F209→I210/M212→S213/N214→Y215/S215→D216/T216→K217/S217 - - - /D218E/H219Q/L220S/Y221K/E238D/K252Q/P281S/Q292K/L313C/S314T/L315M/T317S/Q321A/E333D/K336R/L337V A345T/G357R/N369I/S377Y/T405R/N429G/A436S/E484D/T501P/D536E;

S2P/S3D/G4R/E5T/T6G/F7P/R19K/K24Q/Q38N/T53L/D54A/A55T/E56G/D57R/V60I/A85M/I86L/Q87D/K88H/L89I/C90Y/- - -→R91/- - -→A92/- - -→D93/I92→Y95/Y93→F96/I94→E97/D95→A98/S96→H99/N97→E100/R98→Y101/A99→N102/K125→Q128/K173→Q176/L175→ - - - /V176→ - - - /Q178→A179/D179→P180/V181→L182/T182→K183/P183→S184/K184→P185/F209→I210/M212→S213/N214→Y215/S215→D216/T216→K217/S217 - - - /D218E/H219Q/L220S/Y221K/E238D/K252Q/P281S/Q292K/L313C/S314T/L315M/T317S/Q321A/E333D/K336R/L337I/A345T/G357R/N369I/S377Y/T405R/N429G/A436S/E484D/T501P/D536E;

R19K/K24Q/Q38N/T53L/D54A/A55T/E56G/D57R/V60I/A85M/I86L/Q87D/K88H/L89I/C90Y/ - - - →R91/ - - - →A92/ - - - →D93/I92→Y95/Y93→F96/I94→E97/D95→A98/S96→H99/N97→E100/R98→Y101/A99→N102/K125→Q128/K173→Q176/L175→ - - - /V176→ - - - /Q178→A179/D179→P180/V181→L182/T182→K183/P183→S184/K184→P185/F209→I210/M212→R213/N214→D215/H219→D220/Y221→V222/E238→D239/K252→Q253/P281→S282/Q292→K293/L313→C314/S314→T315/L315→M316/T317→S318/Q321→A322/E333→D334/K336→R337/L337→I338/A345→T346/G357→R358/N369→I370/S377→Y378/T405→R406/N429→G430/A436→S437/E484→D485/T501→P502/D536→E537;

R19K/K24Q/Q38N/T53L/D54A/A55T/E56G/D57R/V60I/A85M/I86L/Q87D/K88H/L89I/C90Y/ - - - →R91/ - - - →A92/ - - - →D93/I92→Y95/Y93→F96/I94→E97/D95→A98/S96→H99/N97→E100/R98→Y101/A99→N102/K125→Q128/K173→Q176/L175→ - - - /V176→ - - - /Q178→A179/D179→P180/V181→L182/T182→K183/P183→S184/K184→P185/F209→E210/M212→R213/N214→D215/H219→D220/Y221→V222/E238→D239/K252→Q253/P281→S282/Q292→K293/L313→C314/S314→T315/L315→M316/T317→S318/Q321→A322/E333→D334/K336→R337/L337→I338/A345→T346/G357→R358/N369→I370/S377→Y378/T405→R406/N429→G430/A436→S437/E484→D485/T501→P502/D536→E537;

K24Q/Q38N/T53L/D54A/A55T/E56G/D57R/V60I/A85M/I86L/Q87D/K88H/L89/C90Y/ - - - →R91/ - - - →A92/ - - - →D93/I92→Y95/Y93→F96/I94→E97/D95→A98/S96→H99/N97→E100/R98→Y101/A99→N102/L111→S114/K125→Q128/K173→Q176/L175→ - - - /Q178→A179/D179→P180/V181→L182/T182→K183/P183→S184/K184→P185/F209→E210/M212→R213/N214→D215/H219→D220/Y221→V222/E238→D239/K252→Q253/P281→S282/Q292→K293/L313→C314/S314→T315/L315→M316/T317→S318/Q321→A322/E333→D334/K336→R337/L337→I338/A345→T346/G357→R358/N369→I370/S377→Y378/T405→R406/N429→G430/A436→S437/E484→D485/T501→P502/D536→E537;

R19K/K24Q/Q38N/T53L/D54A/A55T/E56G/D57R/V60I/A85M/I86L/Q87D/K88H/L89I/C90Y/ - - - →R91/ - - - →A92/ - - - →D93/I92→Y95/Y93→F96/I94→E97/D95→A98/S96→H99/N97→E100/R98→Y101/A99→N102/K125→Q128/K173→Q176/L175→ - - - /V176→ - - - /Q178→A179/D179→P180/V181→L182/T182→K183/P183→S184/K184→P185/F209→L210/M212→R213/N214→D215/H219→D220/Y221→V222/E238→D239/K252→Q253/P281→S282/Q292→K293/L313→C314/S314→T315/L315→M316/T317→S318/Q321→A322/E333→D334/K336→R337/L337→I338/A345→T346/G357→R358/N369→I370/S377→Y378/T405→R406/N429→G430/A436→S437/E484→D485/T501→P502/D536→E537;

R19K/K24Q/Q38N/T53L/D54A/A55T/E56G/D57R/V60I/A85M/I86L/Q87D/K88H/L89I/C90Y/ - - - →R91/ - - - →A92/ - - - →D93/I92→Y95/Y93→F96/I94→E97/D95→A98/S96→H99/N97→E100/R98→Y101/A99→N102/K125→Q128/K173→Q176/L175→ - - - /V176→ - - - /Q178→A179/D179→P180/V181→L182/T182→K183/P183→S184/K184→P185/F209→T210/M212→R213/N214→D215/H219→D220/Y221→V222/E238→D239/K252→Q253/P281→S282/Q292→K293/L313→C314/S314→T315/L315→M316/T317→S318/Q321→A322/E333→D334/K336→R337/L337→I338/A345→T346/G357→R358/N369→I370/S377→Y378/T405→R406/N429→G430/A436→S437/E484→D485/T501→P502/D536→E537;

R19K/K24Q/Q38N/T53L/D54A/A55T/E56G/D57R/V60I/A85M/I86L/Q87D/K88H/L89I/C90Y/ - - - →R91/ - - - →A92/ - - - →D93/I92→Y95/Y93→F96/I94→E97/D95→A98/S96→H99/N97→E100/R98→Y101/A99→N102/K125→Q128/K173→Q176/L175→ - - - /V176→ - - - /Q178→A179/D179→P180/V181→L182/T182→K183/P183→S184/K184→P185/F209→I210/M212→A213/I213→F214/N214→L215/S215→A216/T216→C217/S217→G218/D218→R219/H219→R220/L220→P221/Y221→T222/E238→D239/K252→Q253/Q292→K293/L313→C314/S314→T315/L315→M316/T317→S318/Q321→A322/E333→D334/K336→R337/L337→I338/A345→T346/G357→R358/N369→I370/S377→Y378/T405→R406/N429→G430/A436→S437/T501→P502/D536→E537;

S2A/S3T/G4S/E5H/T6S/F7Q/R19K/K24Q/Q38N/T53L/D54A/A55T/E56G/D57R/V60I/A85M/I86L/Q87D/K88H/L89I/C90Y/- - -→R91/- - -→A92/- - -→D93/I92→Y95/Y93→F96/I94→E97/D95→A98/S96→H99/N97→E100/R98→Y101/A99→N102/K125→Q128/K173→Q176/L175→ - - - /V176→ - - - /Q178→A179/D179→P180/V181→L182/T182→K183/P183→S184/K184→P185/

F209→I210/M212→S213/N214→Y215/S215→D216/T216→K217/S217 - - - /D218E/H219Q/L220S/Y221K/E238D/K252Q/P281S/Q292K/L313C/S314T/L315M/T317S/Q321A/I325T/E333D/K336R/L337I/A345T/G357R/N369I/S377Y/T405R/N429G/A436S/E484D/T501P/D536E;

S3T/G4Q/E5V/ - - - →S6/ - - - →S7/ - - - →S8/ - - - →S9/ - - - →L10/ - - - →A11/ - - - →Q12/ - - - →I13/ - - - →P14/ - - - →Q15/ - - - →P16/T6→K17/F7→N18/T10→V21/D12→N23/S16→N27/L17→I28/R19→G30/N20→D31/H21→Q32/L23→I34/K24→T35/G25→Y36/A26→T37/S27→P38/D28→E39/F29→D40/T31→ - - - /D33→T43/H34→R44/T35→A45/A36→C46/T37→K47/Q38→E48/R40→Q50/H41→I51/T53→L63/D54→A64/A55→T65/E56→G66/D57→R67/V60→I70/A85→M95/I86→L96/Q87→D97/K88→H98/L89→I99/C90→Y100/ - - - →R101/ - - - →A102/ - - - →D103/I92→Y105/Y93→F106/I94→E107/D95→A108/S96→H109/N97→E110/R98→Y111/A99→N112/K125→Q138/K173→Q186/L175→ - - - /V176→ - - - /Q178→A189/D179→P190/V181→L192/T182→K193/P183→S194/K184→P195/F209→I220/M212→R223/N214→D225/H219→D230/Y221→V232/E238→D249/K252→Q263/P281→S292/Q292→K303/L313→C324/S314→T325/L315→M326/T317→S328/Q321→A332/E333→D344/K336→R347/L337→I348/A345→T356/G357→R368/N369→I380/S377→Y388/T405→R416/N429→G440/A436→S447/E484→D495/T501→P512/D536→E547;

K24Q/Q38N/K58Q/V60I/I86L/K88H/L89I/P91N/I92N/Y93F/I94H/S96C/R98D/A99M/ - - - →G101/ - - - →D102/K125→Q127/K173→Q175/K184→R186/F209→I211/M212→R214/N214→D216/H219→D221/Y221→V223/E238→D240/K252→Q254/P281→S283/Q292→K294/L313→C315/S314→T316/L315→M317/T317→S319/Q321→A323/E333→D335/K336→R338/L337→I339/A345→T347/G357→R359/N369→I371/S377→Y379/T405→R407/N429→G431/A436→S438/T501→P503/D536→E538;

K24Q/Q38N/K58Q/V60I/I86L/K88H/L89I/P91N/I92S/Y93F/I94H/S96C/R98D/A99M/ - - - →G101/ - - - →D102/K125→Q127/K173→Q175/K184→R186/F209→I211/M212→R214/N214→D216/H219→D221/Y221→V223/E238→D240/K252→Q254/P281→S283/Q292→K294/L313→C315/S314→T316/L315→M317/T317→S319/Q321→A323/E333→D335/K336→R338/L337→I339/A345→T347/G357→R359/N369→I371/S377→Y379/Y387→C389/T405→R407/N429→G431/A436→S438/T501→P503/D536→E538;

S3T/G4Q/E5V/ - - - →S6 - - - →A7/ - - - →S8/ - - - →S9/ - - - →L10/ - - - →A11/ - - - →Q12/ - - - →I13/ - - - →P14/ - - - →Q15/ - - - →P16/T6→K17/F7→N18/T10→V21/D12→N23/S16→N27/L17→I28/R19→G30/N20→D31/H21→Q32/L23→I34/K24→T35/G25→Y36/A26→T37/S27→P38/D28→E39/F29→D40/T31→ - - - /D33→T43/H34→R44/T35→G45/A36→C46/T37→K47/Q38→E48/R40→Q50/H41→I51/T53→L63/D54→A64/A55→T65/E56→G66/D57→R67/V60→I70/A85→M95/I86→L96/Q87→D97/K88→H98/L89→I99/C90→Y100/ - - - →R101/ - - - →A102/ - - - →D103/I92→Y105/Y93→F106/I94→E107/D95→A108/S96→H109/N97→E110/R98→Y111/A99→N112/K125→Q138/K173→Q186/L175→ - - - /V176→ - - - /Q178→A189/D179→P190/V181→L192/T182→K193/P183→S194/K184→P195/F209→I220/M212→V223/I213→Y224/N214→ - - - /S215→ - - - /T216→Q225/S217→D226/D218→E227/H219→A228/L220→F229/Y221→H230/E238→D247/K252→Q261/P281→S290/Q292→K301/L313→C322/S314→T323/L315→M324/T317→S326/Q321→A330/E333→D342/K336→R345/L337→I346/A345→T354/G357→R366/N369→I378/S377→Y386/T405→R414/N429→G438/A436→S445/E484→D493/T501→P510/D536→E545;

R19K/K24Q/Q38N/T53L/D54A/A55T/E56G/D57R/V60I/A85M/I86L/Q87D/K88H/L89I/C90Y/ - - - →R91/ - - - →A92/ - - - →D93/I92→Y95/Y93→F96/I94→E97/D95→A98/S96→H99/N97→E100/R98→Y101/A99→N102/K125→Q128/K173→Q176/L175→ - - - /V176→ - - - /Q178→A179/D179→P180/V181→L182/T182→K183/P183→S184/K184→P185/F209→I210/M212→R213/N214→V215/H219→D220/Y221→V222/E238→D239/K252→Q253/P281→S282/Q292→K293/L313→C314/S314→T315/L315→M316/T317→S318/Q321→A322/E333→D334/K336→R337/L337→I338/A345→T346/G357→R358/N369→I370/S377→Y378/T405→R406/N429→G430/A436→S437/E484→D485/T501→P502/P506→S507/D536→E537;

R19K/K24Q/Q38N/T53L/D54A/A55T/E56G/D57R/V60I/A85M/I86L/Q87D/K88H/L89I/C90Y/ - - - →R91/ - - - →A92/ - - - →D93/I92→Y95/Y93→F96/I94→E97/D95→A98/S96→H99/N97→E100/R98→Y101/A99→N102/K125→Q128/K173→Q176/L175→ - - - /V176→ - - - Q178→A179/D179→P180/V181→L182/T182→K183/P183→S184/K184→P185/F209→I210/M212→R213/N214→D215/H219→D220/Y221→V222/E238→D239/K252→Q253/T257→A258/P281→S282/Q292→K293/L313→C314/S314→T315/L315→M316/T317→S318/Q321→A322/E333→D334/K336→R337/L337→I338/A345→T346/G357→R358/N369→I370/S377→Y378/T405→R406/N410→S411/N429→G430/A436→S437/E484→D485/T501→P502/D536→E537;

R19K/K24Q/Q38N/T53L/D54A/A55T/E56G/D57R/V69L/A85M/I86L/Q87D/K88H/L89I/C90Y/ - - - →R91/ - - - →A92/ - - - →D93/I92→Y95/Y93→F96/I94→E97/D95→A98/S96→H99/N97→E100/R98→Y101/A99→N102/K125→Q128/K173→Q176/L175→ - - - /V176→ - - - /Q178→A179/D179→P180/V181→L182/T182→K183/P183→S184/K184→P185/F209→I210/M212→R213/N214→D215/H219→D220/Y221→V222/E238→D239/K252→Q253/P281→S282/Q292→K293/L313→C314/S314→T315/L315→M316/T317→S318/Q321→A322/E333→D334/K336→R337/L337→I338/A345→T346/G357→R358/N369→I370/S377→Y378/T405→R406/N429→G430/A436→S437/E484→D485/T501→P502/D536→E537;

R19K/K24P/Q38Y/T53L/D54A/A55T/E56G/D57R/V60I/A85M/I86L/Q87D/K88H/L89I/C90Y/ - - - →R91/ - - - →A92/ - - - →D93/I92→Y95/Y93→F96/I94→E97/D95→A98/S96→H99/N97→E100/R98→Y101/A99→N102/K125→Q128/K173→Q176/L175 - - - →/V176→ - - - /Q178→A179/D179→P180/V181→L182/T182→K183/P183→S184/K184→P185/F209→I210/M212→V213/I213→Y214/N214 - - - /S215→ - - - /T216→Q215/S217→D216/D218→E217/H219→A218/L220→H219/Y221→H220/E238→D237/K252→Q251/P281→S280/Q292→K291/L313→C312/S314→T313/L315→M314/T317→S316/Q321→A320/E333→D332/K336→R335/L337→I336/A345→T344/G357→R356/N369→I368/S377→Y376/T405→R404/N429→G428/A436→S435/E484→D483/T501→P500/D536→E535;

S2K/S3E/G4C/E5T/T6M/F7L/R19K/K24Q/Q38N/T53L/D54A/A55T/E56G/D57R/V60I/A85M/I86L/Q87D/K88H/L89I/C90Y/ - - - →R91/ - - - →A92/ - - - →D93/I92→Y95/Y93→F96/I94→E97/D95→A98/S96→H99/N97→E100/R98→Y101/A99→N102/K125→Q128/K173→Q176/

L175→ - - - /V176→ - - - /Q178→A179/D179→P180/V181→L182/T182→K183/P183→S184/K184→P185/F209→I210/M212→S213/N214→Y215/S215→D216/T216→K217/S217→ - - - /D218E/H219Q/L220S/Y221K/E238D/K252Q/P281S/Q292K/L313C/S314T/L315M/T317S/Q321A/E333D/K336R/L337I/A345T/G357R/N369I/S377Y/T405R/N429G/A436S/E484D/T501P/D536E;

S2K/S3E/G4C/E5T/T6M/F7L/R19K/K24Q/Q38N/T53L/D54A/A55T/E56G/D57R/V60I/A85M/I86L/Q87D/K88H/L89I/C90Y/ - - - →R91/ - - - →A92/ - - - →D93/I92→Y95/Y93→F96/I94→E97/D95→A98/S96→H99/N97→E100/R98→Y101/A99→N102/K125→Q128/K173→Q176/L175→ - - - /V176→ - - - /Q178→A179/D179→P180/V181→L182/T182→K183/P183→S184/K184→P185/F209→I210/M212→S213/N214→Y215/S215→D216/T216→K217/S217→ - - - /D218E/H219Q/L220S/Y221K/E238D/K252Q/P281S/Q292K/L313C/S314A/L315M/T317S/Q321A/E333D/K336R/L337I/A345T/E348A/G357R/N369I/S377Y/T405R/N429G/A436S/E484D/T501P/D536E;

S2C/S3M/G4T/E5G/T6E/F7S/R19K/K24Q/Q38N/T53L/D54A/A55T/E56G/D57R/V60I/A85M/I86L/Q87D/K88H/L89I/C90Y/ - - - →R91/ - - - →A92/ - - - →D93/I92→Y95/Y93→F96/I94→E97/D95→A98/S96→H99/N97→E100/R98→Y101/A99→N102/K125→Q128/K173→Q176/L175→ - - - /V176→ - - - /Q178→A179/D179→P180/V181→L182/T182→K183/P183→S184/K184→P185/F209→I210/M212→S213/N214→Y215/S215→D216/T216→K217/S217→ - - - /D218E/H219Q/L220S/Y221K/E238D/K252Q/P281S/Q292K/L313C/S314T/L315M/T317S/Q321A/E333D/K336R/L337I/A345T/G357R/N369I/S377Y/T405R/N429G/A436S/E484D/T501P/D536E;

S2C/S3M/G4T/E5G/T6E/F7S/R19K/K24Q/Q38N/T53L/D54A/A55T/E56G/D57R/V60I/A85M/I86L/Q87D/K88H/L89I/C90Y/ - - - →R91/ - - - →A92/ - - - →D93/I92→Y95/Y93→F96/I94→E97/D95→A98/S96→H99/N97→E100/R98→Y101/A99→N102/K125→Q128/K173→Q176/L175→ - - - /V176→ - - - /Q178→A179/D179→P180/V181→L182/T182→K183/P183→S184/K184→P185/F209→I210/M212→S213/N214→Y215/S215→D216/T216→K217/S217→ - - - /D218E/H219Q/L220S/Y221K/E238D/K252Q/P281S/Q292K/L313C/S314T/L315M/T317S/Q321A/E333D/K336R/L337I/A345T/G357R/N369I/S377Y/T405R/N429G/A436S/E484D/T501P/D536E;

R19K/K24Q/Q38N/T53L/D54A/A55T/E56G/D57R/V60I/A85M/I86L/Q87D/K88H/L89I/C90Y/ - - - →R91/ - - - →A92/ - - - →D93/I92→Y95/Y93→F96/I94→E97/D95→A98/S96→H99/N97→E100/R98→Y101/A99→N102/K125→Q128/K173→Q176/L175 - - - →/V176→ - - - /Q178→A179/D179→P180/V181→L182/T182→K183/P183→S184/K184→P185/F209→I210/M212→V213/I213→Y214/N214→ - - - /S215→ - - - 214/T216→Q215/S217→D216/D218→E217/H219→A218/L220→F219/Y221→H220/E238→D237/K252→Q251/P281→S280/Q292→K291/L313→C312/S314→T313/L315→M314/T317→S316/Q321→A320/E333→D332/K336→R335/L337→I336/A345→T344/G357→R356/N369→I368/S377→Y376/T405→R404/N429→G428/A436→S435/V439→L438/E484→D483/T501→P500/D536→E535;

S2A/S3G/G4E/E5A/F7G/R19K/K24Q/Q38N/T53L/D54A/A55T/E56G/D57R/V60I/A85M/I86L/Q87D/K88H/L89I/C90Y/ - - - →R91/ - - - →A92/ - - - →D93/I92→Y95/Y93→F96/I94→E97/D95→A98/S96→H99/N97→E100/R98→Y101/A99→N102/K125→Q128/K173→Q176/L175→ - - - /V176→ - - - /Q178→A179/D179→P180/V181→L182/T182→K183/P183→S184/K184→P185/F209→I210/M212→R213/N214→P215/H219→D220/Y221→V222/E238→D239/K252→Q253/P281→S282/Q292→K293/L313→C314/S314→T315/L315→M316/T317→S318/Q321→A322/E333→D334/K336→R337/L337→I338/A345→T346/G357→R358/N369→I370/S377→Y378/T405→R406/N429→G430/A436→S437/E484→D485/K499→E500/T501→P502/D536→E537;

S2C/S3M/G4T/E5G/T6E/F7S/R19K/K24Q/Q38N/T53L/D54A/A55T/E56G/D57R/V60I/A85M/I86L/Q87D/K88H/L89I/C90Y/ - - - →R91/ - - - →A92/ - - - →D93/I92→Y95/Y93→F96/I94→E97/D95→A98/S96→H99/N97→E100/R98→Y101/A99→N102/K125→Q128/K173→Q176/L175→ - - - /V176→ - - - /Q178→A179/D179→P180/V181→L182/T182→K183/P183→S184/K184→P185/F209→I210/M212→S213/N214→Y215/S215→D216/T216→K217/S217→ - - - /D218E/H219Q/L220S/Y221K/E238D/K252Q/P281S/Q292K/L313C/S314T/L315M/T317S/Q321A/E333D/K336R/L337I/A345T/G357R/N369I/S377Y/T405R/N429G/A436S/E484D/T501P/D536E;

S2K/S3E/G4C/E5T/T6M/F7L/R19K/K24Q/Q38N/T53L/D54A/A55T/E56G/D57R/V60I/A85M/I86L/Q87D/K88H/L89I/C90Y/ - - - →R91/ - - - →A92/ - - - →D93/I92→Y95/Y93→F96/I94→E97/D95→A98/S96→H99/N97→E100/R98→Y101/A99→N102/K125→Q128/K173→Q176/L175→ - - - /V176→ - - - /Q178→A179/D179→P180/V181→L182/T182→K183/P183→S184/K184→P185/F209→I210/M212→S213/N214→Y215/S215→D216/T216→K217/S217→ - - - /D218E/H219Q/L220S/Y221K/E238D/K252Q/P281S/Q292K/L313C/S314T/L315M/T317S/Q321A/E333D/K336R/L337I/A345T/G357R/N369I/S377Y/T405R/N429G/A436S/E484D/T501P/D536E;

S2K/S3E/G4C/E5T/T6M/F7L/R19K/K24Q/Q38N/T53L/D54A/A55T/E56G/D57R/V60I/A85M/I86L/Q87D/K88H/L89I/C90Y/ - - - →R91/ - - - →A92/ - - - →D93/I92→Y95/Y93→F96/I94→E97/D95→A98/S96→H99/N97→E100/R98→Y101/A99→N102/K125→Q128/K173→Q176/L175→ - - - /V176→ - - - /Q178→A179/D179→P180/V181→L182/T182→K183/P183→S184/K184→P185/F209→I210/M212→S213/N214→Y215/S215→D216/T216→K217/S217→ - - - /D218E/H219Q/L220S/Y221K/E238D/K252Q/P281S/Q292K/L313C/S314T/L315M/T317S/Q321A/E333D/K336R/L337I/A345T/G357R/N369I/S377Y/T405R/N429G/A436S/E484D/T501P/D536E;

R19K/K24Q/Q38N/T53L/D54A/A55T/E56G/D57R/V60I/A85M/I86L/Q87D/K88H/L89I/C90Y/ - - - →R91/ - - - →A92/ - - - →D93/I92→Y95/Y93→F96/I94→E97/D95→A98/S96→H99/N97→E100/R98→Y101/A99→N102/I116→Y119/K117→T120/V122→I125/E124→N127/K127→T130/D129→E132/E130→R133/S135→E138/S136→A139/N139→S142/Q142→R145/S146→G149/K173→Q176/L175→ - - - /V176→ - - - /Q178→A179/D179→P180/V181→L182/T182→K183/P183→S184/K184→P185/F209→I210/M212→R213/N214→D215/H219→D220/Y221→V222/E238→D239/K252→Q253/P281→S282/Q292→K293/L313→C314/S314→T315/L315→M316/T317→S318/Q321→A322/E333→D334/K336→R337/L337→I338/A345→T346/G357→R358/N369→I370/S377→Y378/T405→R406/N429→G430/A436→S437/E484→D485/T501→P502/D536→E537;

S2K/S3E/G4C/E5T/T6M/F7L/R19K/K24Q/Q38N/T53L/D54A/A55T/E56G/D57R/V60I/A85M/I86L/Q87D/K88H/L89I/C90Y/ - - - →R91/ - - - →A92/ - - - →D93/I92→Y95/Y93→F96/I94→E97/D95→A98/S96→H99/N97→E100/R98→Y101/A99→N102/K125→Q128/K173→Q176/L175→ - - - /V176→ - - - /Q178→A179/D179→P180/V181→L182/T182→K183/P183→S184/K184→P185/F209→I210/M212→S213/N214→Y215/S215→D216/T216→K217/S217→ - - - /D218E/H219Q/L220S/Y221K/E238D/K252Q/P281S/Q292K/L313C/S314T/L315M/T317S/Q321A/E333D/K336R/L337I/A345T/G357R/N369I/S377Y/T405R/N429G/A436S/E484D/T501P/D536E;

A11T/R19K/K24Q/Q38N/T53L/D54A/A55T/E56G/D57R/V60I/A85M/I86L/Q87D/K88H/L89I/C90Y/ - - - →R91/ - - - →A92/ - - - →D93/I92→Y95/Y93→F96/I94→E97/D95→A98/S96→H99/N97→E100/R98→Y101/A99→N102/K125→Q128/K173→Q176/L175→ - - - /V176→ - - - /Q178→A179/D179→P180/V181→L182/T182→K183/P183→S184/K184→P185/F209→I210/M212→R213/N214→D215/H219→D220/Y221→V222/E238→D239/K252→Q253/P281→S282/Q292→K293/L313→C314/S314→T315/L315→M316/T317→S318/Q321→A322/E333→D334/K336→R337/L337→I338/A345→T346/G357→R358/N369→I370/S377→Y378/T405→R406/N429→G430/A436→S437/E484→D485/T501→P502/D536→E537;

M1T/R19K/K24Q/Q38N/T53L/D54A/A55T/E56G/D57R/V60I/A85M/I86L/Q87D/K88H/L89I/C90Y/ - - - →R91/ - - - →A92/ - - - →D93/I92→Y95/Y93→F96/I94→E97/D95→A98/S96→H99/N97→E100/R98→Y101/A99→N102/K125→Q128/Y152→H155/K173→Q176/L175→ - - - /V176→ - - - /Q178→A179/D179→P180/V181→L182/T182→K183/P183→S184/K184→P185/F209→I210/M212→R213/N214→D215/H219→D220/Y221→V222/E238→D239/K252→Q253/P281→S282/Q292→K293/L313→C314/S314→T315/L315→M316/T317→S318/Q321→A322/E333→D334/K336→R337/L337→I338/A345→T346/G357→R358/C361→R362/N369→I370/S377→Y378/T405→R406/N429→G430/A436→S437/K468→Q469/E484→D485/T501→P502/D536→E537;

S2C/S3M/G4T/E5G/T6E/F7S/R19K/K24Q/Q38N/T53L/D54A/A55T/E56G/D57R/V60I/A85M/I86L/Q87D/K88H/L89I/C90Y/ - - - →R91/ - - - →A92/ - - - →D93/I92→Y95/Y93→F96/I94→E97/D95→A98/S96→H99/N97→E100/R98→Y101/A99→N102/K125→Q128/K173→Q176/L175→ - - - /V176→ - - - /Q178→A179/D179→P180/V181→L182/T182→K183/P183→S184/K184→P185/F209→I210/M212→S213/N214→Y215/S215→D216/T216→K217/S217→ - - - /D218E/H219Q/L220S/Y221K/E238D/K252Q/P281S/Q292K/L313C/S314T/L315M/T317S/Q321A/E333D/K336R/L337I/A345T/G357R/N369V S377Y/T405R/N429G/A436S/E484D/T501P/D536E;

S2C/S3M/G4T/E5G/T6E/F7S/R19K/K24Q/Q38N/T53L/D54A/A55T/E56G/D57R/V60I/A85M/I86L/Q87D/K88H/L89I/C90Y/ - - - →R91/ - - - →A92 - - - →D93/I92→Y95/Y93→F96/I94→E97/D95→A98/S96→H99/N97→E100/R98→Y101/A99→N102/K125→Q128/K173→Q176/L175→ - - - /Q178→A179/D179→P180/V181→L182/T182→K183/P183→S184/K184→P185/F209→I210/M212→S213/N214→Y215/S215→D216/T216→K217/S217→ - - - /D218E/H219Q/L220S/Y221K/E238D/K252Q/P281S/Q292K/L313C/S314T/L315M/T317S/Q321A/E333D/K336R/L337I/A345T/G357R/N369I/S377Y/T405R/N429G/A436S/E484D/T501P/D536E;

S2K/S3E/G4C/E5T/T6M/F7L/R19K/K24Q/Q38N/T53L/D54A/A55T/E56G/D57R/V60I/A85M/I86L/Q87D/K88H/L89I/C90Y/ - - - →R91/ - - - →A92/ - - - →D93/I92→Y95/Y93→F96/I94→E97/D95→A98/S96→H99/N97→E100/R98→Y101/A99→N102/K125→Q128/K173→Q176/L175→ - - - /V176→ - - - /Q178→A179/D179→P180/V181→L182/T182→K183/P183→S184/K184→P185/T200→Q201/F209→I210/M212→S213/N214→Y215/S215→D216/T216→K217/S217→ - - - /D218E/H219Q/L220S/Y221K/E238D/K252Q/P281S/Q292K/L313C/S314T/L315M/T317S/Q321A/E333D/K336R/L337I/A345T/G357R/N369I/S377Y/T405R/N429G/A436S/E484D/T501P/D536E;

R19K/K24Q/Q38N/T53L/D54A/A55T/E56G/D57R/V60I/A85M/I86L/Q87D/K88H/L89I/C90Y/ - - - →R91/ - - - →A92/ - - - →D93/I92→Y95/Y93→Y96/I94→E97/D95→A98/S96→H99/N97→E100/R98→Y101/A99→N102/K125→Q128/K173→Q176/L175→ - - - /V176→ - - - /Q178→A179/D179→P180/V181→L182/T182→K183/P183→S184/K184→P185/F209→I210/M212→R213/N214→D215/H219→D220/Y221→V222/E238→D239/K252→Q253/P281→S282/Q292→K293/L313→C314/S314→T315/L315→M316/T317→S318/Q321→A322/E333→D334/K336→R337/L337→I338/A345→T346/G357→R358/N369→I370/S377→Y378/T405→R406/N429→G430/A436→S437/Q448→L449/E484→D485/T501→P502/D536→E537;

R19K/K24Q/Q38N/T53L/D54A/A55T/E56G/D57R/V60I/A85M/I86L/Q87D/K88H/L89I/C90Y/ - - - →R91/ - - - →A92/ - - - →D93/I92→Y95/Y93→F96/I94→E97/D95→A98/S96→H99/N97→E100/R98→Y101/A99→N102/K125→Q128/E163→D166/K173→Q176/L175→ - - - /V176→ - - - /Q178→A179/D179→P180/V181→L182/T182→K183/P183→S184/K184→P185/F209→I210/M212→R213/N214→D215/H219→D220/Y221→V222/E238→D239/K252→Q253/P281→S282/Q292→K293/L313→C314/S314→T315/L315→M316/T317→S318/Q321→A322/E333→D334/K336→R337/L337→I338/A345→T346/G357→R358/N369→I370/S377→Y378/T405→R406/N429→G430/A436→S437/Q448→L449/E484→D485/T501→P502/D536→E537;

R19K/K24Q/Q38N/T53L/D54A/A55T/E56G/D57R/V60I/A85M/I86L/Q87D/K88H/L89I/C90Y/ - - - →R91/ - - - →A92/ - - - →D93/I92→Y95/Y93→F96/I94→E97/D95→A98/S96→H99/N97→E100/R98→Y101/A99→N102/K125→Q128/K173→Q176/L175→ - - - /V176→ - - - /Q178→A179/D179→P180/V181→L182/T182→K183/P183→S184/K184→P185/F209→I210/M210→T211/M212→R213/N214→D215/H219→D220/Y221→V222/E238→D239/K252→Q253/P281→S282/Q292→K293/L313→C314/S314→T315/L315→M316/T317→S318/Q321→A322/E333→D334/K336→R337/L337→I338/A345→T346/G357→R358/N369→I370/S377→Y378/T405→R406/N429→G430/A436→S437/E484→D485/P500→L501/T501→P502/D536→E537;

R19K/K24Q/Q38N/T53L/D54A/A55T/E56G/D57R/V60I/A85M/I86L/Q87D/K88H/L89I/C90Y/ - - - →R91/ - - - →A92/ - - - →D93/I92→Y95/Y93→F96/I94→E97/D95→A98/S96→H99/N97→E100/R98→Y101/A99→N102/K125→Q128/K173→Q176/L175→ - - - /V176→ - - - /Q178→A179/D179→P180/V181→L182/T182→K183/P183→S184/K184→P185/F209→I210/M212→R213/N214→D215/H219→D220/Y221→V222/E238→D239/K252→Q253/P281→S282/Q292→K293/L313→C314/S314→T315/L315→M316/T317→S318/Q321→A322/E333→D334/K336→R337/L337→I338/

A345→T346/G357→R358/N369→I370/S377→Y378/T405→R406/N429→G430/A436→S437/E484→D485/T501→P502/D536→E537;

R19K/N20D/L23S/K24Q/Q38N/T53L/D54A/A55T/E56G/D57R/V60I/A85M/I86L/Q87D/K88H/L89I/C90Y/ - - - →R91/ - - - →A92/ - - - →D93/I92→Y95/Y93→F96/I94→E97/D95→A98/S96→H99/N97→E100/R98→Y101/A99→N102/K125→Q128/K173→E176/L175→ - - - /V176→ - - - /Q178→A179/D179→P180/V181→L182/T182→K183/P183→S184/K184→P185/F209→I210/M212→R213/N214→D215/H219→D220/Y221→V222/E238→D239/K252→Q253/P281→S282/Q292→K293/L313→C314/S314→T315/L315→M316/T317→S318/Q321→A322/E333→D334/K336→R337/L337→I338/A345→T346/G357→R358/N369→I370/S377→Y378/T405→R406/N429→G430/A436→S437/C465→S466/E484→D485/T501→P502/D536→E537/A539→V540;

S2C/S3M/G4T/E5G/T6E/F7S/R19K/K24Q/Q38N/T53L/D54A/A55T/E56G/D57R/V60I/A85M/I86L/Q87D/K88H/L89I/C90Y/ - - - →R91/ - - - →A92 - - - →D93/I92→Y95/Y93→F96/I94→E97/D95→A98/S96→H99/N97→E100/R98→Y101/A99→N102/K125→Q128/K173→Q176/L175→ - - - /V176→ - - - /Q178→A179/D179→P180/V181→L182/T182→K183/P183→S184/K184→P185/F209→I210/M212→S213/N214→Y215/S215→D216/T216→K217/S217→ - - - /D218E/H219Q/L220S/Y221K/E238D/K252Q/P281S/Q292K/L313C/S314T/L315M/T317S/Q321A/E333D/K336R/L337I/A345T/E348A/G357R/N369I/S377Y/T405R/N429G/A436S/E484D/T501P/D536E;

S2C/S3M/G4T/E5G/T6E/F7S/R19K/K24Q/Q38N/T53L/D54A/A55T/E56G/D57R/V60I/A85M/I86L/Q87D/K88H/L89I/C90Y/ - - - →R91/ - - - →A92/ - - - →D93/I92→Y95/Y93→F96/I94→E97/D95→A98/S96→H99/N97→E100/R98→Y101/A99→N102/K125→Q128/K173→Q176/L175→ - - - /V176→ - - - /Q178→A179/D179→P180/V181→L182/T182→K183/P183→S184/K184→P185/F209→I210/M212→S213/N214→Y215/S215→D216/T216→K217/S217→ - - - /D218E/H219Q/L220S/Y221K/E238D/K252Q/P281S/Q292K/L313C/S314T/L315M/T317S/Q321A/E333D/K336R/L337I/A345T/E348S/G357R/N369I/S377Y/T405R/N429G/A436S/E484D/T501P/D536E/;

K24Q/Q38N/K58Q/V60I/K88Q/P91N/I92S/Y93F/I94H/S96C/R98D/A99M/ - - - →G101/ - - - →D102/K125→Q127/K173→Q175/K184→R186/F209→I211/M212→R214/N214→D216/H219→D221/Y221→V223/E238→D240/K252→Q254/Q292→K294/Q321→A323/E333→D335/A345→T347/N369→I371/S377→Y379/T405→R407/N429→G431/A436→S438/T501→P503/D536→E538;

K24Q/Q38N/K58Q/V60I/I82V/K88Q/P91N/I92S/Y93F/I94H/S96C/R98D/A99M/ - - - →G101/ - - - →D102/K125→Q127/K173→Q175/K184→R186/F209→I211/M212→R214/N214→D216/H219→D221/Y221→V223/E238→D240/K252→Q254/Q292→K294/Q321→A323/E333→D335/A345→T347/N369→I371/S377→Y379/L399→S401/T405→R407/N429→G431/A436→S438/T501→P503/D536→E538;

S3T/G4Q/E5V/ - - - →S6/ - - - →A7/ - - - →S8/ - - - →S9/ - - - →L10/ - - - →A11/ - - - →Q12/ - - - →I13/ - - - →P14/ - - - →Q15/ - - - →P16/T6→K17/F7→N18/T10→V21/D12→N23/S16→N27/L17→I28/R19→G30/N20→D31/H21→Q32/L23→I34/K24→T35/G25→Y36/A26→T37/S27→P38/D28→E39/F29→D40/T31→ - - - /D33→T43/H34→R44/T35→G45/A36→C46/T37→K47/Q38→E48/R40→Q50/H41→I51/V48→I58/T53→L63/D54→A64/A55→T65/E56→G66/D57→R67/V60→I70/I86→L96/K88→H98/L89→I99/P91→N101/I92→S102/Y93→F103/I94→H104/S96→C106/R98→D108/A99→M109/ - - - →G111/ - - - →D112/H102→Y114/I116→Y128/K117→T129/V122→I134/E124→N136/K127→T139/D129→E141/E130→R142/S135→E147/S136→A148/N139→S151/Q142→R154/S146→G158/K173→Q185/L175→ - - - /V176→ - - - /Q178→A188/D179→P189/V181→L191/T182→K192/P183→S193/K184→P194/F209→I219/M212→V222/I213→Y223/N214→ - - - /S215→ - - - /T216→Q224/S217→D225/D218→E226/H219→A227/L220→F228/Y221→H229/E238→D246/K252→Q260/P281→S289/Q292→K300/L313→C321/S314→T322/L315→M323/T317→S325/Q321→A329/E333→D341/K336→R344/L337→I345/A345→T353/G357→R365/N369→I377/S377→Y385/T405→R413/N429→G437/A436→S444/E484→D492/T501→P509/D536→E544;

S3T/G4Q/E5V/ - - - →S6/ - - - →A7/ - - - →S8/ - - - →S9/ - - - →L10/ - - - →A11/ - - - →Q12/ - - - →I13/ - - - →P14/ - - - →Q15/ - - - →P16/T6→K17/F7→N18/T10→V21/D12→N23/S16→N27/L17→I28/R19→G30/N20→D31/H21→Q32/L23→I34/K24→T35/G25→Y36/A26→T37/S27→P38/D28→E39/F29→D40/T31→ - - - /D33→T43/H34→R44/T35→A45/A36→C46/T37→K47/Q38→E48/R40→Q50/H41→I51/T53→L63/D54→A64/A55→T65/E56→G66/D57→R67/V60→I70/I86→L96/K88→H98/L89→I99/P91→N101/I92→S102/Y93→F103/I94→H104/S96→C106/R98→D108/A99→M109/ - - - →G111/ - - - →D112/K125→Q137/K173→Q185/L175→ - - - /V176→ - - - /Q178→A188/D179→P189/V181→L191/T182→K192/P183→S193/K184→P194/F209→I219/M212→V222/I213→Y223/N214→ - - - /S215→ - - - /T216→Q224/S217→D225/D218→E226/H219→A227/L220→F228/Y221→H229/E238→D246/K252→Q260/P281→S289/Q292→K300/L313→C321/S314→T322/L315→M323/T317→S325/Q321→A329/E333→D341/K336→R344/L337→I345/A345→T353/G357→R365/N369→I377/S377→Y385/T405→R413/N429→G437/A436→S444/E484→D492/T501→P509/D536→E544; and S3T/G4Q/E5V/ - - - →S6/ - - - →A7/ - - - →S8/ - - - →S9/ - - - →L10/ - - - →A11/ - - - →Q12/ - - - →I13/ - - - →P14/ - - - →Q15/ - - - →P16/T6→K17/F7→N118/T10→V21/D12→N23/S16→N27/L17→I28/R19→G30/N20→D31/H21→Q32/L23→I34/K24→T35/G25→Y36/A26→T37/S27→P38/D28→E39/F29→D40/D33→T43/H34→R44/T35→A45/A36→C46/T37→K47/Q38→E48/R40→Q50/H41→I51/T53→L63/D54→A64/A55→T65/E56→G66/D57→R67/V60→I70/A85→M95/I86→L96/Q87→D97/K88→H98/L89→I99/C90→Y100/ - - - →R101/ - - - →A102/ - - - →D103/I92→Y105/Y93→F106/I94→E107/D95→A108/S96→H109/N97→E110/R98→Y111/A99→N112/K125→Q138/K173→Q186/L175→ - - - /V176→ - - - /Q178→A189/D179→P190/V181→L192/T182→K193/P183→S194/K184→P195/F209→I220/M212→V223/I213→Y224/N214→ - - - /S215→ - - - /T216→Q225/S217→D226/D218→E227/H219→A228/L220→F229/Y221→H230/E238→D247/K252→Q261/P281→S290/Q292→K301/L313→C322/S314→T323/L315→M324/T317→S326/Q321→A330/E333→D342/K336→R345/L337→I346/A345→T354/G357→R366/N369→I378/S377→Y386/T405→R414/N429→G438/A436→S445/E484→D493/T501→P510/D536→E545.

Provided herein are nucleic acid molecules having a sequence of nucleic acids set forth in any of SEQ ID NO: 203, 352-353, 702, 703, 713-715, 776-799, 801-809, 891-894, 896, 945, 947, 949, 951, 953, 955, 957, 959, 961, 963, 965, 967, 969, 971, 973, 975, 977, 979, 981, 983, 985, 987, 989, 991, 993, 995, 997 and 999. Also provided herein are nucleic acid molecules having a sequence of nucleic acids that has at least 95% sequence identity to any of SEQ ID NO: 203, 352-353, 702, 703, 713-715, 776-799, 801-809, 891-894, 896, 945, 947, 949, 951, 953, 955, 957, 959, 961, 963, 965, 967, 969, 971, 973, 975, 977, 979, 981, 983, 985, 987, 989, 991, 993, 995, 997 and 999. Also provided herein are nucleic acid molecules having a sequence of nucleic acids that degenerate to any of SEQ ID NO: 203, 352-353, 702, 703, 713-715, 776-799, 801-809, 891-894, 896, 945, 947, 949, 951, 953, 955, 957, 959, 961, 963, 965, 967, 969, 971, 973, 975, 977, 979, 981, 983, 985, 987, 989, 991, 993, 995, 997 and 999. For example, provided herein are nucleic acid molecules having a sequence of nucleic acids set forth in any of SEQ ID NO: 203, 352-353, 702, 703, 713-715, 776-799, 801-809, 891-894, 896, 945, 947, 949, 951, 953, 955, 957, 959, 961, 963, 965, 967, 969, 971, 973, 975, 977, 979, 981, 983, 985, 987, 989, 991, 993, 995, 997 and 999.

Provided herein are nucleic acid molecules that encode a modified valencene synthase having a sequence of amino acids set forth in any of SEQ ID NOS: 67, 350, 351, 732-733, 743-745, 833-856, 858-866, 887-890 and 895. Also provided herein are nucleic acid molecules that encode a modified valencene synthase having a sequence of amino acids that has at least 95% sequence identity to a sequence of amino acids set forth in any of SEQ ID NOS: 67, 350, 351, 732-733, 743-745, 833-856, 858-866, 887-890 and 895. For example, provided herein are nucleic acid molecules that encode a modified valencene synthase having a sequence of amino acids set forth in any of SEQ ID NOS: 67, 350, 351, 732-733, 743-745, 833-856, 858-866, 887-890 and 895.

In one example, the nucleic acid molecules provided herein can encode a modified valencene synthase having amino acid replacements corresponding to amino acid replacements selected from among K24A/Q38A/K58A/V60I/K88A/Y93H/N97D/R98K/K125A/K173A/K184R/F209I/M212R/N214D/H219D/Y221V/E238D/K252A/Q292K/V320S/Q321A/E326K/E333D/A345T/N369I/S377Y/T405R/N429G/A436S/T501P/D536E; and K24A/Q38A/R50G/K58A/V60I/K88A/Y93H/N97D/R98K/K125A/K173A/K184R/F209I/M212R/N214D/H219D/Y221V/E238D/K252A/Q292K/V320G/Q321A/E333D/A345T/N369I/S377Y/T405R/N429G/A436S/T501P/D536E; and one or more further amino acid replacements.

Provided herein are nucleic acid molecules encoding a modified valencene synthase polypeptide wherein the unmodified valencene synthase polypeptide has the sequence of amino acids set forth in any of SEQ ID NOS: 2-4, 289-291, 346, 347, 752, 882 and 883.

Provided herein are nucleic acid molecules encoding a modified Citrus valencene synthase, wherein the modified valencene synthase contains amino acid differences compared to a citrus-derived valencene synthase. In some examples, the nucleic acid encodes a modified grapefruit or orange valencene synthase, wherein the modified valencene synthase contains amino acid differences compared to a grapefruit-derived or orange-derived valencene synthase. In one aspect, the citrus-derived valencene synthase has a sequence of amino acids set forth in any of SEQ ID NOS:2, 289-291, 752 and 886. In some embodiments, the encoded modified valencene synthase polypeptide is a fusion protein or chimeric protein.

In some embodiments, the nucleic acid molecules provided herein encode a modified valencene synthase polypeptide that exhibits increased catalytic activity compared to the valencene synthase set forth in SEQ ID NO:2. In other embodiments, the encoded modified valencene synthase polypeptide exhibits altered substrate specificity compared to the valencene synthase set forth in SEQ ID NO:2. In further embodiments, the encoded modified valencene synthase polypeptide exhibits altered product distribution compared to the valencene synthase set forth in SEQ ID NO:2.

For example, as described above, cells expressing modified valencene synthase polypeptides provided herein produce increased valencene compared to cells expressing wildtype valencene synthase set forth in SEQ ID NO:2. In some examples, modified valencene synthase polypeptides provided herein also produce a decreased percentage of terpene products (e.g terpene byproduct or products derived therefrom) other than valencene compared to the percentage of the same terpene products (e.g. terpene byproduct or products derived therefrom) produced in the same host cell from a valencene synthase set forth in SEQ ID NO:2, whereby the terpene products are produced by the synthase in a host cell that produces FPP. For example, the terpene products other than valencene that can be produced include, but are not limited to, β-selinene, τ-selinene, eremophilone, 7-epi-α-selinene, germacrene A or β-elemene. For example, germacrene A is detected as its spontaneous degradation product β-elemene, which is a product derived from the germacrene A byproduct that undergoes a heat induced rearrangement to form β-elemene. In particular examples, the terpene product is β-elemene. For example, modified valencene synthase polypeptides provided herein produce 95%, 80%, 70%, 60%, 50%, 40%, 30%, 20%, 10% or less levels of β-elemene than is produced by wildtype valencene synthase set forth in SEQ ID NO:2. The percentage of terpene product other than valencene as a percentage of total terpene product produced by the provided modified valencene synthase polypeptide is decreased by 0.01% to 90%, such as 1% to 80%, 5% to 80%, 10% to 60% or 0.01% to 20%. For example, the percentage of a terpene product other than valencene as a percentage of total terpene is decreased by at least or at least about 0.5%, 1%, 2%, 3%, 4%, 5%, 6%, 7%, 8%, 9%, 10%, 20%, 30%, 40%, 50%, 60%, 70%, 80%, 90% or more. Exemplary of such nucleic acid molecules are nucleic acid molecules that encode a modified valencene polypeptide that contains amino acid replacement(s) at positions corresponding to positions 281, 313, 314, 315, 317, 336, 337, 347, or 357 with CVS numbering relative to the valencene synthase polypeptide set forth in SEQ ID NO:2. For example, the amino acid replacement is P281S, P281H, P281K, P281A, P281W, P281L, P281Y, L313C, S314T, L315M, T317S, K336R, L337I, N347L, and/or G357R. In some examples, the nucleic acid molecule encodes a modified valencene synthase polypeptide that contains replacements at positions 281, 313, 314, 315, 317, 336, 337, and 357 with numbering relative to the valencene synthase polypeptide set forth in SEQ ID NO:2. In further examples, the nucleic acid molecule also can contain an amino acid replacement at position 347. For example, the encoded modified valencene synthase polypeptide contains replacements P281S, L313C, S314T, L315M, T317S, K336R, L337I and G357R. In another example, the encoded modified valencene synthase polypeptide contains replacements P281S, L313C, S314T, L315M, T317S, K336R, L337I, N347L and G357R. The encoded modified valencene synthase polypeptide also can contain other amino acid replacements so long as production of a terpene product, such as β-elemene, is decreased.

Also provided herein are modified valencene synthase polypeptides encoded by any of the nucleic acid molecules provided herein.

Also provided are vectors containing the nucleic acid molecules provided herein. Vectors include prokaryotic, viral and eukaryotic vectors, such as for example, yeast vectors, including yeast expression vectors. Cells, including prokaryotic, such as bacterial cells, and eukaryotic, such as yeast, insect, plant or mammalian cells, containing the vectors are provided. In one example, the cell is a yeast cell, for example, a *Saccharomyces* genus cell or a *Pichia* genus cell. In an exemplary embodiment, the yeast cell is a *Saccharomyces cerevisiae* cell. In another example, the cell is a bacterial cell, for example, an *Escherichia coli* cell. The cells provided herein produce FPP. In a particular embodiment, the cells are modified to produce more FPP than a cell that has not been modified. For example, the cell contains a modification in the gene encoding squalene synthase, whereby the amount the squalene synthase expressed in the cell or the activity the squalene synthase expressed in the cell is reduced compared to an unmodified cell. Also provided herein are cells that express a modified valencene synthase polypeptide. Also provided herein are modified valencene synthases produced by a cell provided herein.

Also provided herein are transgenic plants containing a vector provided herein. In some examples, the transgenic plant is a Citrus plant. In other examples, the transgenic plant is a tobacco.

Provided herein are methods for producing a modified valencene synthase polypeptide wherein a nucleic acid molecule or vector provided herein is introduced into a cell and the cell is cultured under conditions suitable for the expression of the modified valencene synthase polypeptide encoded by the nucleic acid or vector. Also provided herein are methods for producing a modified valencene synthase polypeptide wherein a nucleic acid molecule or vector provided herein is introduced into a cell and the cell is cultured under conditions suitable for the expression of the modified valencene synthase polypeptide encoded by the nucleic acid or vector wherein the modified valencene synthase polypeptide is modified. In some examples, the modified valencene synthase polypeptide is isolated.

Provided herein is a method of producing valencene wherein an acyclic pyrophosphate terpene precursor is contacted with any modified valencene synthase polypeptide provided herein or any modified valencene synthase polypeptide encoded by any nucleic acid molecule provided herein, under conditions suitable for the formation of valencene from the acyclic pyrophosphate terpene precursor. Also provided herein is a method of producing valencene wherein an acyclic pyrophosphate terpene precursor is contacted with any modified valencene synthase polypeptide provided herein or encoded by any nucleic acid molecule provided herein, under conditions suitable for the formation of valencene from the acyclic pyrophosphate terpene precursor whereby the valencene is isolated. In one embodiment, the step of contacting the acyclic pyrophosphate terpene precursor with the modified valencene synthase polypeptide is effected in vitro or in vivo. The acyclic pyrophosphate terpene precursor used in the method provided herein can be selected from among farnesyl diphosphate (FPP), geranyl diphosphate (GPP) and geranyl-geranyl diphosphate (GGPP). In a particular embodiment, the acyclic pyrophosphate terpene precursor is FPP.

Provided herein is a method of producing valencene by culturing a cell transformed with the nucleic acid molecule or vector provided herein, wherein the cell produces an acyclic pyrophosphate terpene precursor, the modified valencene synthase polypeptide encoded by the nucleic acid molecule or vector is expressed, and the modified valencene synthase polypeptide catalyzes the formation of valencene from the acyclic pyrophosphate terpene precursor. The acyclic pyrophosphate terpene precursor used in the method provided herein can be selected from among farnesyl diphosphate (FPP), geranyl diphosphate (GPP) and geranyl-geranyl diphosphate (GGPP). In a particular embodiment, the acyclic pyrophosphate terpene precursor can be FPP. In the method provided herein, the cell can be selected from among a bacteria, yeast, insect, plant or mammalian cell. In a particular embodiment, the cell is a yeast cell that is a *Saccharomyces cerevisiae* cell. The cells provided herein produce FPP. In a particular embodiment, the cells are modified to produce more FPP than a cell that has not been modified. For example, the cell contains a modification in the gene encoding squalene synthase, whereby the amount the squalene synthase expressed in the cell or the activity the squalene synthase expressed in the cell is reduced compared to an unmodified cell.

In one embodiment of the method of producing valencene by culturing a cell transformed with the nucleic acid molecule or vector provided herein, the amount of valencene produced is greater than the amount of valencene produced under the same conditions when the same host cell type is transformed with nucleic acid encoding the valencene synthase set forth in SEQ ID NO:2. For example, the amount of valencene produced is at least or about 10%, 20%, 30%, 40%, 50%, 60%, 70%, 80%, 90%, 100%, 110%, 120%, 130%, 140%, 150%, 160%, 170%, 180%, 190%, 200%, 250%, 300%, 350%, 400%, 500% or more greater than the amount of valencene produced under the same conditions by the valencene synthase set forth in SEQ ID NO:2. In another example, the amount of valencene produced is 10% to 500%, 10% to 250%, 50% to 250%, 100% to 500% or is 100% to 250% greater than the amount of valencene produced from FPP by the valencene synthase set forth in SEQ ID NO:2. In another embodiment, the amount of valencene produced in the cell culture supernatant is at least or about 0.1 g/L, 0.2 g/L, 0.3 g/L, 0.4 g/L, 0.5 g/L, 0.6 g/L, 0.7 g/L, 0.8 g/L, 0.9 g/L 1.0 g/L, 1.1 g/L, 1.2 g/L, 1.3 g/L, 1.4 g/L, 1.5 g/L, 2.0 g/L, 2.5 g/L, 3.0 g/L, 3.5 g/L, 4.0 g/L, 4.5 g/L or 5.0 g/L; or is 0.1 g/L to 5.0 g/L, 0.1 g/L to 3.0 g/L, 0.5 g/L to 5.0 g/L, 1.0 g/L to 5.0 g/L or 1.0 to 3.0 g/L in the yeast cell culture medium.

In a particular embodiment of the method provided herein, valencene is isolated. In another embodiment, valencene is oxidized to produce nootkatone. The oxidation can be performed biosynthetically or chemically. In another embodiment, the nootkatone is isolated.

Provided herein is a method for producing a modified terpene synthase comprising a heterologous domain wherein all or a contiguous portion of a domain of a first terpene synthase is replaced with all or a contiguous portion of the corresponding domain in a second terpene synthase, the amino acid sequence of the domain or contiguous portion of the domain of the first terpene synthase and second terpene synthases differ by at least one amino acid residue, and the domain is selected from among unstructured loop 1; alpha helix 1; unstructured loop 2; alpha helix 2; unstructured loop 3; alpha helix 3; unstructured loop 4; alpha helix 4; unstructured loop 5; alpha helix 5; unstructured loop 6; alpha helix 6; unstructured loop 7; alpha helix 7; unstructured loop 8; alpha helix 8; unstructured loop 9; alpha helix A; A-C loop; alpha helix C; unstructured loop 11; alpha helix D; unstructured loop 12; alpha helix D1; unstructured loop 13; alpha helix D2; unstructured loop 14; alpha helix E; unstructured loop 15; alpha helix F; unstructured loop 16; alpha helix G1; unstructured loop 17; alpha helix G2; unstructured loop 18; alpha helix H1; unstructured loop 19; alpha helix H2; unstructured loop 20; alpha helix H3; unstructured loop 21; alpha helix a-1; unstructured loop 22; alpha helix I; unstructured loop 23; alpha helix J; J-K loop; alpha helix K; and/or unstructured loop 25, and the contiguous portion contains at least three amino acid residues, whereby a property of the modified terpene synthase is altered compared to the first terpene synthase. For example, the property of the modified terpene synthase is improved compared to the first terpene synthase.

In one embodiment of the method, at least 3, 4, 5, 6, 7, 8, 9, 10, 15, 20 or more amino acid residues from the domain of the first terpene synthase are replaced with at least 3, 4, 5, 6, 7, 8, 9, 10, 15, 20 or more amino acid residues from the corresponding domain of the second terpene synthase. In one aspect, all of the amino acid residues from the domain of the first terpene synthase are replaced all of the amino acid residues from the corresponding domain of the second terpene synthase.

In one embodiment of the method provided herein, unstructured loop 1 contains amino acid residues corresponding to amino acids 1-29 of SEQ ID NO:2; alpha helix 1 contains amino acid residues corresponding to amino acids 30-39 and 44-52 of SEQ ID NO:2; unstructured loop 2 contains amino acid residues corresponding to amino acids 53-58 of SEQ ID NO:2; alpha helix 2 contains amino acid residues corresponding to amino acids 59-71 of SEQ ID NO:2; unstructured-loop 3 contains amino acid residues corresponding to amino acids 72-78 of SEQ ID NO:2; alpha helix 3 contains amino acid residues corresponding to amino acids 79-93 of SEQ ID NO:2; unstructured loop 4 contains amino acid residues corresponding to amino acids 94-100 of SEQ ID NO:2; alpha helix 4 contains amino acid residues corresponding to amino acids 101-114 of SEQ ID NO:2; unstructured loop 5 contains amino acid residues corresponding to amino acids 115-141 of SEQ ID NO:2; alpha helix 5 contains amino acid residues corresponding to amino acids 142-152 of SEQ ID NO:2; unstructured loop 6 contains amino acid residues corresponding to amino acids 153-162 of SEQ ID NO:2; alpha helix 6 contains amino acid residues corresponding to amino acids 163-173 of SEQ ID NO:2; unstructured loop 7 contains amino acid residues corresponding to amino acids 174-184 of SEQ ID NO:2; alpha helix 7 contains amino acid residues corresponding to amino acids 185-194 of SEQ ID NO:2; unstructured loop 8 contains amino acid residues corresponding to amino acids 195-201 of SEQ ID NO:2; alpha helix 8 contains amino acid residues corresponding to amino acids 202-212 of SEQ ID NO:2; unstructured loop 9 contains amino acid residues corresponding to amino acids 213-222 of SEQ ID NO:2; alpha helix A contains amino acid residues corresponding to amino acids 223-253 of SEQ ID NO:2; A-C loop contains amino acid residues corresponding to amino acids 254-266 of SEQ ID NO:2; alpha helix C contains amino acid residues corresponding to amino acids 267-276 of SEQ ID NO:2; unstructured loop 11 contains amino acid residues corresponding to amino acids 277-283 of SEQ ID NO:2; alpha helix D contains amino acid residues corresponding to amino acids 284-305 of SEQ ID NO:2; unstructured loop 12 contains amino acid residues corresponding to amino acids 306-309 of SEQ ID NO:2; alpha helix D1 contains amino acid residues corresponding to amino acids 310-322 of SEQ ID NO:2; unstructured loop 13 contains amino acid residues corresponding to amino acids 323-328 of SEQ ID NO:2; alpha helix D2 contains amino acid residues corresponding to amino acids 329 of SEQ ID NO:2; unstructured loop 14 contains amino acid residues corresponding to amino acids 330-332 of SEQ ID NO:2; alpha helix E contains amino acid residues corresponding to amino acids 333-351 of SEQ ID NO:2; unstructured loop 15 contains amino acid residues corresponding to amino acids 352-362 of SEQ ID NO:2; alpha helix F contains amino acid residues corresponding to amino acids 363-385 of SEQ ID NO:2; unstructured loop 16 contains amino acid residues corresponding to amino acids 386-390 of SEQ ID NO:2; alpha helix G1 contains amino acid residues corresponding to amino acids 391-395 of SEQ ID NO:2; unstructured loop 17 contains amino acid residues corresponding to amino acids 396-404 of SEQ ID NO:2; alpha helix G2 contains amino acid residues corresponding to amino acids 405-413 of SEQ ID NO:2; unstructured loop 18 contains amino acid residues corresponding to amino acids 414-421 of SEQ ID NO:2; alpha helix H1 contains amino acid residues corresponding to amino acids 422-428 of SEQ ID NO:2; unstructured loop 19 contains amino acid residues corresponding to amino acids 429-431 of SEQ ID NO:2; alpha helix H2 contains amino acid residues corresponding to amino acids 432-447 of SEQ ID NO:2; unstructured loop 20 contains amino acid residues corresponding to amino acids 448-450 of SEQ ID NO:2; alpha helix H3 contains amino acid residues corresponding to amino acids 451-455 of SEQ ID NO:2; unstructured loop 21 contains amino acid residues corresponding to amino acids 456-461 of SEQ ID NO:2; alpha helix a-1 contains amino acid residues corresponding to amino acids 462-470 of SEQ ID NO:2; unstructured loop 22 contains amino acid residues corresponding to amino acids 471-473 of SEQ ID NO:2; alpha helix I contains amino acid residues corresponding to amino acids 474-495 of SEQ ID NO:2; unstructured loop 23 contains amino acid residues corresponding to amino acids 496-508 of SEQ ID NO:2; alpha helix J contains amino acid residues corresponding to amino acids 509-521 of SEQ ID NO:2; J-K loop contains amino acid residues corresponding to amino acids 522-534 of SEQ ID NO:2; alpha helix K contains amino acid residues corresponding to amino acids 535-541 of SEQ ID NO:2; and unstructured loop 25 contains amino acid residues corresponding to amino acids 542-548 of SEQ ID NO:2.

In one embodiment of the provided method, all or a contiguous portion of two or more domains of a first terpene synthase are replaced with all or a contiguous portion of the corresponding domains of a second terpene synthase. In the method provided herein, one or more additional residues adjacent to the domain in the first terpene synthase are replaced. For example, at least or about 1, 2, 3, 4, 5 or more additional residues adjacent to the domain in the first terpene synthase are replaced.

In one embodiment of the method provided herein, amino acids corresponding to amino acids 53-58 of SEQ ID NO:2 in a first terpene synthase are replaced with the corresponding region from a second terpene synthase. In another embodiment, amino acids corresponding to amino acids 85-99 of SEQ ID NO:2 in a first terpene synthase are replaced with the corresponding region from a second terpene synthase. In another embodiment, amino acids corresponding to amino acids 115-146 of SEQ ID NO:2 in a first terpene synthase are replaced with the corresponding region from a second terpene synthase. In yet another embodiment, amino acids corresponding to amino acids 153-162 or 152-163 of SEQ ID NO:2 in a first terpene synthase are replaced with the corresponding region from a second terpene synthase. In a further embodiment, amino acids corresponding to amino acids 174-184 of SEQ ID NO:2 in a first terpene synthase are replaced with the corresponding region from a second terpene synthase. In another embodiment, amino acids corresponding to amino acids 212-222 or 212-221 or 213-222 of SEQ ID NO:2 in a first terpene synthase are replaced with the corresponding region from a second terpene synthase. In one embodiment, amino acids corresponding to amino acids 310-322 of SEQ ID NO:2 in a first terpene synthase are replaced with the corresponding region from a second terpene synthase. In another embodiment, amino acids corresponding to amino acids 522-534 of SEQ ID NO:2 in a first terpene synthase are replaced with the corresponding region from a second terpene synthase. In yet another embodiment, amino acids corresponding to amino acids 53-58 of SEQ ID NO:2 in a first terpene synthase are replaced with amino acids 58-63 of the TEAS polypeptide set forth in SEQ ID NO:295 or 941.

In one embodiment of the method, amino acids corresponding to amino acids 85-89 of SEQ ID NO:2 in a first terpene synthase are replaced with amino acids 93-97 of the HPS polypeptide set forth in SEQ ID NO:942. In another embodiment, amino acids corresponding to amino acids 85-99 of SEQ ID NO:2 in a first terpene synthase are replaced with amino acids 96-113 of the *Vitis vinifera* valencene synthase set forth in SEQ ID NO:346. In another embodiment, amino acids corresponding to amino acids 115-146 of SEQ ID NO:2 in a first terpene synthase are replaced with amino acids 128-159 of the *Vitis vinifera* valencene synthase set forth in SEQ ID NO:346. In yet another embodiment, amino acids corresponding to amino acids 152-163 of SEQ ID NO:2 in a first terpene synthase are replaced with amino acids 163-174 of the HPS polypeptide set forth in SEQ ID NO:942. In another embodiment, amino acids corresponding to amino acids 174-184 of SEQ ID NO:2 in a first terpene synthase are replaced with amino acids 185-193 of the HPS polypeptide set forth in SEQ ID NO:942. In yet another embodiment, wherein amino acids corresponding to amino acids 212-222 or 212-221 of SEQ ID NO:2 in a first terpene synthase are replaced with amino acids 221-228 or 221-229 of the HPS polypeptide set forth in SEQ ID NO:942.

In one embodiment of the method, amino acids corresponding to amino acids 310-322 of SEQ ID NO:2 in a first terpene synthase are replaced with amino acids 317-329 of the HPS polypeptide set forth in SEQ ID NO:942. In another embodiment, amino acids corresponding to amino acids 522-534 of SEQ ID NO:2 in a first terpene synthase are replaced with amino acids 527-541 of the HPS polypeptide set forth in SEQ ID NO:942. In yet another embodiment of the method, amino acids corresponding to amino acids 212-221 or 212-222 of the valencene synthase polypeptide set forth in SEQ ID NO:2 in a first terpene synthase are replaced with amino acids 213-221 of the TEAS polypeptide set forth in SEQ ID NO:295. In one embodiment of the method, amino acids 212-221 or 212-222 of the valencene synthase polypeptide set forth in SEQ ID NO:2 in a first terpene synthase are replaced with amino acids 223-230 of the *Vitis vinifera* valencene synthase set forth in SEQ ID NO:346. In another embodiment of the method, amino acids corresponding to amino acids 3-41 of the valencene synthase polypeptide set forth in SEQ ID NO:2 in a first terpene synthase are replaced with amino acids 3-51 of the *Vitis vinifera* valencene synthase set forth in SEQ ID NO:346.

In one embodiment of the method provided herein, the first terpene is a sesquiterpene. In another embodiment, the second terpene is a sesquiterpene. For example, the sesquiterpene can be selected from among a valencene synthase, a santalane synthase, TEAS and TIPS. In one example, the santalene synthase has a sequence of amino acids selected from among SEQ ID NOS:481-485. In another embodiment of the method provided herein, a plurality of domains in a terpene synthase are replaced with the corresponding domains from two or more other terpenes.

In the method provided herein, a property of the modified terpene synthase can be improved compared to the first terpene synthase. For example, the property of the modified terpene synthase that is improved compared to the first terpene synthase is selected from among total terpene yield; specific terpene yield; catalytic activity, product distribution; and substrate specificity.

Also provided herein are modified terpene synthases produced by any of the methods provided herein.

BRIEF DESCRIPTION OF THE FIGURES

FIGS. 1A-D: FIGS. 1A-D are an alignment of the consecutive sequence of amino acids of various citrus valencene synthases (CVS), including species variants and modified valencene synthases, including citrus valencene synthases from *Citrus sinensis* (SEQ ID NO:2; 289; 886) and *Citrus x paradise* (SEQ ID NO:290; 291; 752). Also included are modified valencene synthases provided herein containing amino acid amino acid replacements (V18 set forth as SEQ ID NO:3; and V19 set forth as SEQ ID NO:4). A "*" means that the residues or nucleotides in that column are identical in all sequences in the alignment, a ":" means that conserved substitutions have been observed, and a "." means that semi-conserved substitutions are observed. As described herein and FIGS. 4A-D, residues corresponding to positions in SEQ ID NO:2 can be identified based on CVS numbering as residues that occur at aligned loci between and among related or variant synthases.

FIGS. 2A-C: FIGS. 2A-C are an alignment of the consecutive sequence of amino acids that identifies corresponding regions between and among exemplary synthases (e.g. valencene synthase from *Vitis vinifera* set forth in SEQ ID NO:346; 5-epi-aristolochene synthase (TEAS) from *Nicotiana tabacum* set forth in SEQ ID NO:295; and premnaspirodiene synthase (HPS) from *Hyoscyamus muticus* set forth in SEQ ID NO:296) with respect to citrus valencene synthase set forth in SEQ ID NO:2. The alignment indicates structural domains, including unstructured loop 1 (UL 1; corresponding to amino acids 1-29 of SEQ ID NO:2); alpha helix 1 (AH 1; corresponding to amino acids 30-39 and 44-52 of SEQ ID NO:2); unstructured loop 2 (UL 2; corresponding to amino acids 53-58 of SEQ ID NO:2); alpha helix 2 (AH 2; corresponding to amino acids 59-71 of SEQ ID NO:2); unstructured loop 3 (UL 3; corresponding to amino acids 72-78 of SEQ ID NO:2); alpha helix 3 (AH 3; corresponding to amino acids 79-93 of SEQ ID NO:2); unstructured loop 4 (UL 4; corresponding to amino acids 94-100 of SEQ ID NO:2); alpha helix 4 (AH 4; corresponding to amino acids 101-114 of SEQ ID NO:2); unstructured loop 5 (UL 5; corresponding to amino acids 115-141 of SEQ ID NO:2); alpha helix 5 (AH 5; corresponding to amino acids 142-152 of SEQ ID NO:2); unstructured loop 6 (UL 6; corresponding to amino acids 153-162 of SEQ ID NO:2); alpha helix 6 (AH 6; corresponding to amino acids 163-173 of SEQ ID NO:2); unstructured loop 7 (UL 7; corresponding to amino acids 174-184 of SEQ ID NO:2); alpha helix 7 (AH 7; corresponding to amino acids 185-194 of SEQ ID NO:2); unstructured loop 8 (UL 8; corresponding to amino acids 195-201 of SEQ ID NO:2); alpha helix 8 (AH 8; corresponding to amino acids 202-212 of SEQ ID NO:2); unstructured loop 9 (UL 9; corresponding to amino acids 213-222 of SEQ ID NO:2); alpha helix A (AH A; corresponding to amino acids 223-253 of SEQ ID NO:2); A-C loop (corresponding to amino acids 254-266 of SEQ ID NO:2); alpha helix C (AH C; corresponding to amino acids 267-276 of SEQ ID NO:2); unstructured loop 11 (UL 11; corresponding to amino acids 277- 283 of SEQ ID NO:2); alpha helix D (AH D; corresponding to amino acids 284-305 of SEQ ID NO:2); unstructured loop 12 (UL 12; corresponding to amino acids 306-309 of SEQ ID NO:2); alpha helix Dl (AH Dl; corresponding to amino acids 310-322 of SEQ ID NO:2); unstructured loop 13 (UL 13; corresponding to amino acids 323-328 of SEQ ID NO:2); alpha helix D2 (AH D2; corresponding to amino acids 329 of SEQ ID NO:2); unstructured loop 14 (UL 14; corresponding to amino acids 330-332 of SEQ ID NO:2); alpha helix E (AH E; corresponding to amino acids 333-351 of SEQ ID NO:2); unstructured loop 15 (UL 15; corresponding to amino acids 352-362 of SEQ ID NO:2); alpha helix F (AH F; corresponding to amino acids 363-385 of SEQ ID NO:2); unstructured loop 16 (UL 16; corresponding to amino acids 386-390 of SEQ ID NO:2); alpha helix G 1 (AH G 1; corresponding to amino acids 391-395 of SEQ ID NO:2); unstructured loop 17 (UL 17; corresponding to amino acids 396-404 of SEQ ID NO:2); alpha helix G2 (AH G2; corresponding to amino acids 405-413 of SEQ ID NO:2); unstructured loop 18 (UL 18; corresponding to amino acids 414-421 of SEQ ID NO:2); alpha helix HI (AH HI; corresponding to amino acids 422-428 of SEQ ID NO:2); unstructured loop 19 (UL 19; corresponding to amino acids 429-431 of SEQ ID NO:2); alpha helix H2 (AH H2; corresponding to amino acids 432-447 of SEQ ID NO:2); unstructured loop 20 (UL 20; corresponding to amino acids 448-450 of SEQ ID NO:2); alpha helix H3 (AH H3; corresponding to amino acids 451-455 of SEQ ID NO:2); unstructured loop 21 (UL 21; corresponding to amino acids 456-461 of SEQ ID NO:2); alpha helix a-1 (AH a-1; corresponding to amino acids 462-470 of SEQ ID NO:2); unstructured loop 22 (UL 22; corresponding to amino acids 471-473 of SEQ ID NO:2); alpha helix I (AH I; corresponding to amino acids 474-495 of SEQ ID NO:2); unstructured loop 23 (UL 23; corresponding to amino acids 496-508 of SEQ ID NO:2); alpha helix J (AH J; corresponding to amino acids 509-521 of SEQ ID NO:2); J-K loop (corresponding to amino acids 522-534 of SEQ ID NO:2); alpha helix K (AH K; corresponding to amino acids 535-541 of SEQ ID NO:2); and unstructured loop 25 (UL 25; corresponding to amino acids 542-548 of SEQ ID NO:2). The grey box indicates amino acid residues that are not part of any secondary structure domain. A "*" means that the residues or nucleotides in that column are identical in all sequences in the alignment, a ":" means that conserved substitutions have been observed, and a "." means that semi-conserved substitutions are observed. As described herein, residues corresponding to structural regions in SEQ ID NO:2 can be identified in other synthases as residues that occur at aligned loci between and among synthases. For example, the unstructured loop 2 of valencene synthase (amino acids 53-58 of SEQ ID NO:2) corresponds to amino acids 58-63 of the tobacco epi-aristolochene synthase (TEAS) polypeptide set forth in SEQ ID NO:294.

FIG. 3 is the reaction scheme for the production of valencene and nootkatone. Valencene synthases are class 1 plant terpene cyclases or synthases that convert farnesyl diphosphate (FPP) into the sesquiterpene valencene. Valencene can then be converted to nootkatone by oxidation.

FIGS. 4A-D: FIGS. 4A-D set forth alignments indicating CVS numbering of various terpene synthases. FIG. 4A. An alignment of 5-epi-aristolochene synthase (TEAS) from *Nicotiana tabacum* set forth in SEQ ID NOS:295 and 941; and citrus valencene synthase set forth in SEQ ID NO:2. FIG. 4B. An alignment of premnaspirodiene synthase (HPS) from *Hyoscyamus muticus* set forth in SEQ ID NOS:296 and 942; and citrus valencene synthase set forth in SEQ ID NO:2. FIG. 4C. An alignment of valencene synthase from *Vitis vinifera* set forth in SEQ ID NOS:346 and 347; and citrus valencene synthase set forth in SEQ ID NO:2. FIG. 4D. An alignment of V277 set forth in SEQ ID NO:887; and citrus valencene synthase set forth in SEQ ID NO:2. A "*" means that the residues or nucleotides in that column are identical in all sequences in the alignment, a ":" means that conserved substitutions have been observed, and a "." means that semi-conserved substitutions are observed.

DETAILED DESCRIPTION

Figure 3:
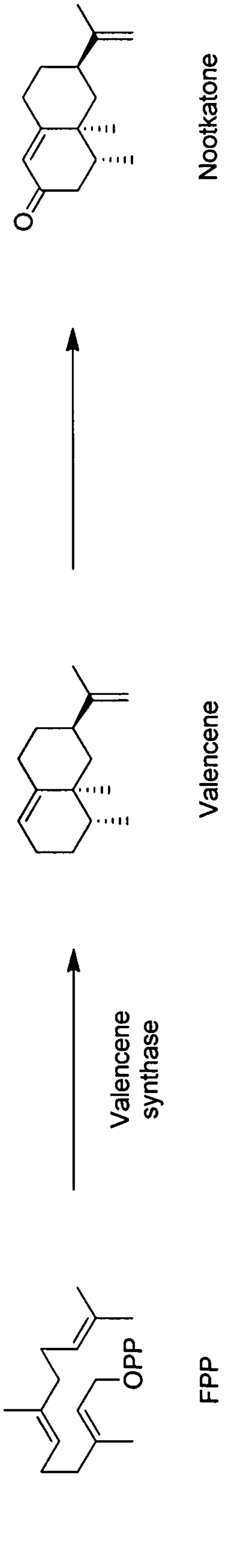
FIG. 3.

A. Definitions
B. Valencene Synthase
1. Structure
2. Function
3. Citrus valencene synthase
C. Modified Valencene Synthase Polypeptides And Encoding Nucleic Acid Molecules
1. Modified valencene synthase polypeptides—Exemplary Amino Acid Replacements
2. Domain Swaps
3. Product Distribution Mutants
D. Methods for producing modified terpene synthases and encoding nucleic acid molecules
E. Production of modified valencene synthase polypeptides and encoding nucleic acid molecules
1. Isolation of nucleic acid encoding terpene synthases
2. Generation of mutant or modified nucleic acid
3. Vectors and Cells
4. Expression systems
a. Prokaryotic cells
b. Yeast cells
c. Plants and plant cells
d. Insects and insect cells
e. Mammalian cells
5. Purification
6. Fusion Proteins
F. Methods of Using and Assessing Valencene Synthase
1. Production of valencene
a. Exemplary cells for valencene production
b. Culture of cells for valencene production
c. Isolation and assessment of valencene
2. Production of Nootkatone
G. Examples

A. Definitions

Unless defined otherwise, all technical and scientific terms used herein have the same meaning as is commonly understood by one of skill in the art to which the invention(s) belong. All patents, patent applications, published applications and publications, GENBANK sequences, websites and other published materials referred to throughout the entire disclosure herein, unless noted otherwise, are incorporated by reference in their entirety. In the event that there is a plurality of definitions for terms herein, those in this section prevail. Where reference is made to a URL or other such identifier or address, it is understood that such identifiers can change and particular information on the internet can come and go, but equivalent information is known and can be readily accessed, such as by searching the internet and/or appropriate databases. Reference thereto evidences the availability and public dissemination of such information.

As used herein, an acyclic pyrophosphate terpene precursor is any acyclic pyrophosphate compound that is a precursor to the production of at least one terpene, including, but not limited to, farnesyl-pyrophosphate (FPP), geranyl-pyrophosphate (GPP), and geranylgeranyl-pyrophosphate (GGPP). Acyclic pyrophosphate terpene precursor are thus substrates for terpene synthases.

As used herein, a terpene is an unsaturated hydrocarbon based on the isoprene unit ($C_5H_8$), and having a general formula $C_{5x}H_{8x}$, such as $C_{10}H_{16}$. Reference to a terpene includes acyclic, monocyclic and polycyclic terpenes. Terpenes include, but are not limited to, monoterpenes, which contain 10 carbon atoms; sesquiterpenes, which contain 15 carbon atoms; diterpenes, which contain 20 carbon atoms, and triterpenes, which contain 30 carbon atoms. Reference to a terpene also includes stereoisomers of the terpene.

As used herein, a terpene synthase is a polypeptide capable of catalyzing the formation of one or more terpenes from an acyclic pyrophosphate terpene precursor, for example, FPP, GPP or GGPP.

As used herein, valencene is a sesquiterpene having the following structure:

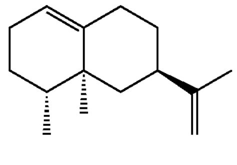

Reference to valencene includes reference to any isomer thereof, including, but not limited to (+)-valencene.

As used herein, a "valencene synthase" or "valencene synthase polypeptide" is a polypeptide capable of catalyzing the formation of valencene from an acyclic pyrophosphate terpene precursor, typically farnesyl diphosphate (FPP). Typically a valencene synthase has greater than or greater than about or 63%, 65%, 70%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% sequence identity with the valence synthase set forth in SEQ ID NO:2. Valencene can be the only product or one of a mixture of products formed from the reaction of an acyclic pyrophosphate terpene precursor with a valencene synthase. The amount of valencene produced from the reaction of a valencene synthase with an acyclic pyrophosphate terpene precursor typically is at least or at least about 1%, 5%, 10%, 20%, 30%, 40%, 50%, 60%, 70%, 80%, 90% or more of the total amount of terpene produced in the reaction. In some instances, valencene is the predominant terpene produced (i.e. present in greater amounts than any other single terpene produced from the reaction of an acyclic pyrophosphate terpene precursor with a valencene synthase).

Reference to a valencene synthase includes any valencene synthase polypeptide including, but not limited to, a recombinantly produced polypeptide, a synthetically produced polypeptide and a valencene synthase polypeptide extracted or isolated from cells and plant matter including, but not limited to, citrus peel. Exemplary valencene synthase polypeptides include those isolated from citrus fruit, grapevine flowers (e.g. *Vitis vinifera* L. cv. Gewürztraminer and *Vitis vinifera* L. cv. Cabernet Sauvignon (see, Lucker et al., (2004) *Phytochemistry* 65(19):2649-59 and Martin et al., (2009) *Proc. Natl. Acad. Sci, USA* 106:7245-7250) SEQ ID NOS:346 and 347) and *perilla* (green shiso). Exemplary of valencene synthases are Citrus valencene synthase (CVS), including but not limited to, valencene synthase from *Citrus sinensis* (Sweet orange) (SEQ ID NOS:2, 289 and 752) and *Citrus x paradisi* (Grapefruit) (SEQ ID NOS:2, 290 and 291). Other exemplary valencene synthase polypeptides include valencene synthase isolated from grapevine flowers, including *Vitis vinifera* L. cv. Gewürztraminer and *Vitis vinifera* L. cv. Cabernet Sauvignon (SEQ ID NOS:346 and 347) and valencene synthase isolated from *Chamaecyparis nootkatensis pendula* (SEQ ID NOS: 882 and 883). Reference to valencene synthase includes valencene synthase from any genus or species, and included allelic or species variants, variants encoded by splice variants, and other variants thereof, including polypeptides that have at least or at least about 40%, 45%, 50%, 55%, 60%, 65%, 70%, 75%, 80%, 85%, 90%, 95%, 96%, 97%, 98%, 99% or more sequence identity to the valencene synthase set forth in SEQ ID NO:2. Valencene synthase also includes fragments thereof that retain valencene synthase activity.

As used herein, "valencene synthase activity" (also referred to herein as catalytic activity) refers to the ability to catalyze the formation of valencene from an acyclic pyrophosphate terpene precursor, such as farnesyl diphosphate (FPP). Methods to assess valencene formation from the reaction of a synthase with an acyclic pyrophosphate terpene precursor, such as FPP, are well known in the art and described herein. For example, the synthase can be expressed in a host cell, such as a yeast cell, that also produces FPP. The production of valencene can then be assessed and quantified using, for example, gas chromatography-mass spectrometry (GC-MS) (see Examples below). A synthase is considered to exhibit valencene synthase activity or the ability to catalyze the formation of valencene from an acyclic pyrophosphate terpene precursor such as FPP if the amount of valencene produced from the reaction is at least or at least about 1%, 5%, 10%, 20%, 30%, 40%, 50%, 60%, 70%, 80%, 90% or more of the total amount of terpene produced in the reaction.

As used herein, "increased catalytic activity" with reference to the activity of a valencene synthase means that the ability to catalyze the formation of valencene from an acyclic pyrophosphate terpene precursor, such as farnesyl diphosphate (FPP), is increased thereby resulting in increased formation of valencene. For purposes herein, a valencene synthase exhibits increased catalytic activity if the amount of valencene produced from FPP by the modified valencene synthase is 10% to 500%, 10% to 250%, 50% to 250%, 100% to 500% or is 100% to 250% greater than the amount of valencene produced from FPP by the valencene synthase set forth in SEQ ID NO:2, such as 10%, 20%, 30%, 40%, 50%, 60%, 70%, 80%, 90%, 100%, 110%, 120%, 130%, 140%, 150%, 160%, 170%, 180%, 190%, 200%, 250%, 300%, 350%, 400%, 500% or more greater than the amount of valencene produced from FPP by the valencene synthase set forth in SEQ ID NO:2. For example, a valencene synthase exhibits increased catalytic activity if the amount of valencene produced from FPP by the modified valencene synthase is at least or about at least 110%, 115%, 120%, 125%, 130%, 135%, 140%, 145%, 150%, 160%, 170%, 180%, 200%, 250%, 300%, 350%, 400%, 500%, 1500%, 2000%, 3000%, 4000%, 5000% of the amount of valencene produced from FPP by wild-type valencene synthase set forth in SEQ ID NO:2 under the same conditions.

As used herein, "wild-type" or "native" with reference to valencene synthase refers to a valencene synthase polypeptide encoded by a native or naturally occurring valencene synthase gene, including allelic variants, that is present in an organism, including a plant, in nature. Reference to wild-type valencene synthase without reference to a species is intended to encompass any species of a wild-type valencene synthase. The amino acid sequence of exemplary valencene synthases are set forth in SEQ ID NOS: 2, (isolated from *Citrus sinensis* cv. Valencia, *Citrus sinensis* cv. Cara Cara and *Citrus x paradisi*), SEQ ID NO:289 (isolated from *Citrus sinensis* cv. Valencia); and SEQ ID NO:290 (isolated from *Citrus paradisi*) and SEQ ID NO:291 (isolated from *Citrus x paradisi*).

As used herein, species variants refer to variants in polypeptides among different species, including different citrus species, such *Citrus sinensis* and *Citrus x paradisi.*

As used herein, allelic variants refer to variations in encoded proteins among members of the same species.

As used herein, a splice variant refers to a variant produced by differential processing of a primary transcript of genomic DNA that results in more than one type of mRNA.

As used herein, "modified valencene synthase polypeptide" refers to a valencene synthase polypeptide that has one or more amino acid differences compared to an unmodified or wild-type valencene synthase polypeptide. The one or more amino acid differences can be amino acid mutations such as one or more amino acid replacements (substitutions), insertions or deletions, or can be insertions or deletions of entire domains, and any combinations thereof. Typically, a modified valencene synthase polypeptide has one or more modifications in the primary sequence compared to an unmodified or wild-type valencene synthase polypeptide. For example, a modified valencene synthase polypeptide provided herein can have at least 1, 5, 10, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 90, 95, 100, 105, 110, 115, 120, 125, 130, 135 or more amino acid differences compared to an unmodified valencene synthase polypeptide. Any modification is contemplated as long as the resulting polypeptide exhibits at least one valencene synthase activity associated with a wild-type valencene synthase polypeptide, such as, for example, catalytic activity, the ability to bind FPP, and/or the ability to catalyze the formation of valencene from FPP.

As used herein, reference to a modified valencene synthase polypeptide producing valencene from FPP in an amount that is greater than the amount of valencene produced from FPP by a reference valencene synthase, such as a wild-type valencene synthase, indicates that the modified valencene synthase produces at least or about 10% more valencene from FPP than the reference valencene synthase produces. For example, such a modified valencene synthase polypeptide can produce at least or at least about 10%, 11%, 12%, 13%, 14%, 15%, 20%, 30%, 40%, 50%, 60%, 70%, 80%, 90%, 100%, 110%, 120%, 130%, 140%, 150%, 160%, 170%, 180%, 190%, 200%, 250%, 300%, 350%, 400%, 500%, 600%, 700%, 800%, 900%, 1000%, 2000%, 5000% or more valencene from FPP compared to the amount of valencene produced from FPP by a reference valencene synthase. The amount of valencene produced from FPP by a valencene synthase can be assessed by any method known in the art. When comparing the amount of valencene produced from FPP by two valencene synthases, such as a modified valencene synthase and a reference valencene synthase, such as a wild-type valencene synthase, it is understood that the assay is performed under the same conditions for each synthase. In one example, the amount of valencene produced from FPP by two valencene synthases, such as a modified valencene synthase and a reference valencene synthase, is assessed by expressing the modified valencene synthase and the reference valencene synthase separately in a yeast cell of the same strain (wherein expression is from the same expression vector) that also produces FPP, and culturing the cells under the same conditions such that valencene is produced. The amount of valencene produced in the cell culture expressing the modified valencene synthase is compared to the amount of valencene produced in the cell culture expressing the reference valencene synthase, using methods of quantification well known in the art, such as GC-MS.

As used herein, "CVS numbering" refers to the amino acid numbering of a valencene synthase set forth in SEQ ID NO:2. Amino acid residues in a synthase other than that set forth in SEQ ID NO:2 can be identified by CVS numbering by alignment of the other terpene synthase with valencene synthase set forth in SEQ ID NO:2. In such an instance, the amino acids of the terpene synthase that align or correspond (i.e. corresponding residues) to amino acids of valencene synthase set forth in SEQ ID NO:2 are identified by the numbering of the valencene synthase amino acids set forth in SEQ ID NO:2. FIGS. 1A-D depict CVS numbering for valencene synthase polypeptides. FIGS. 4A-D depict CVS numbering for exemplary other terpene synthases. For example, in FIGS. 1A-D, the figures depict that by CVS numbering based on SEQ ID NO:2, amino acid residue 24 is a K (Lys) in valencene synthase polypeptides set forth in SEQ ID NOS: 290, 291, 752, 289 and 886), is an A (Ala) in the valencene synthase set forth in SEQ ID NO:3 and is a Q in the valencene synthase polypeptide set forth in SEQ ID NO:4. With reference to FIGS. 4A-D, the figures depict that by CVS numbering based on SEQ ID NO:2, amino acid residue 24 is an S in TEAS set forth in SEQ ID NO:295 or 941, is an S in HPS set forth in SEQ ID NO:942, is a T in valencene synthase from *Vitis* st forth in SEQ ID NO:346 or 347, and is a T in V277 variant valencene synthase set forth in SEQ ID NO:887.

As used herein, corresponding residues refers to residues that occur at aligned loci. Related or variant polypeptides are aligned by any method known to those of skill in the art. Such methods typically maximize matches, and include methods such as using manual alignments and by using the numerous alignment programs available (for example, BLASTP) and others known to those of skill in the art. By aligning the sequences of polypeptides, one skilled in the art can identify corresponding residues, using conserved and identical amino acid residues as guides. Corresponding positions also can be based on structural alignments, for example by using computer simulated alignments of protein structure. For example, amino acid residues R264, W273, T403, Y404, C441 and D445 of the valencene synthase set forth in SEQ ID NO:2 correspond to amino acid residues R264, W273, T403, Y404, C440 and D444 of the tobacco epi-aristolochene synthase set forth in SEQ ID NO:295. In another example, the tyrosine in amino acid position 221 (Y221) of SEQ ID NO:2 corresponds to the cysteine in amino acid position 221 (C221) of SEQ ID NO:289. In other instances, corresponding regions can be identified. For example, the unstructured loop 2 of valencene synthase (amino acids 53-58 of SEQ ID NO:2) corresponds to amino acids 58-63 of the tobacco epi-aristolochene synthase (TEAS) polypeptide set forth in SEQ ID NO:295 (see FIGS. 2A-C).

For purposes herein, reference to modifications as "corresponding to positions . . . with CVS numbering based on SEQ ID NO:2" or similar phrases means the identified amino acid residue that is modified is the amino acid residue as set forth by amino acid number in SEQ ID NO:2 and amino acid residues that align with such residue in another synthase. Thus, reference to a modification, such as an amino acid replacement, that corresponds to, for example, Y221V in SEQ ID NO:2, includes amino acid replacement of the tyrosine at position 221 of SEQ ID NO:2 with a valine; and also includes replacement of the endogenous amino acid residue at the position corresponding to (or aligning with) position 221 of SEQ ID NO:2 in any other similar or related polypeptide, with valine. For example, also included would be replacement of the cysteine at position 221 of SEQ ID NO:289 with a valine (C221V).

As used herein, domain or region (typically a sequence of three or more, generally 5 or 7 or more amino acids) refers to a portion of a molecule, such as a protein or the encoding nucleic acids, that is structurally and/or functionally distinct from other portions of the molecule and is identifiable. A protein can have one, or more than one, distinct domains. For example, a domain can be identified, defined or distinguished by homology of the sequence therein to related family members, such as other terpene synthases. A domain can be a linear sequence of amino acids or a non-linear sequence of amino acids. Many polypeptides contain a plurality of domains. Such domains are known, and can be identified by, those of skill in the art. For exemplification herein, definitions are provided, but it is understood that it is well within the skill in the art to recognize particular domains by name. If needed appropriate software can be employed to identify domains. For example, as discussed above, corresponding domains in different terpene synthases can be identified by sequence alignments, such as using tools and algorithms well known in the art (for example, BLASTP).

As used herein, a functional domain refers to those portions of a polypeptide that is recognized by virtue of a functional activity, such as catalytic activity. A functional domain can be distinguished by its function, such as by catalytic activity, or an ability to interact with a biomolecule, such as substrate binding or metal binding. In some examples, a domain independently can exhibit a biological function or property such that the domain independently or fused to another molecule can perform an activity, such as, for example catalytic activity or substrate binding.

As used herein, a structural domain refers to those portions of a polypeptide chain that can form an independently folded structure within a protein made up of one or more structural motifs.

As used herein, "heterologous" with respect to an amino acid or nucleic acid sequence refers to portions of a sequence that is not present in the native polypeptide or encoded by the native polynucleotide. For example, a portion of amino acids of a polypeptide, such as a domain or region or portion thereof, for a valencene synthase is heterologous thereto if such amino acids is not present in a native or wild-type valencene synthase (e.g. as set forth in SEQ ID NO:2), or encoded by the polynucleotide encoding therefor. Polypeptides containing such heterologous amino acids or polynucleotides encoding therefor are referred to as "chimeric polypeptides" or "chimeric polynucleotides," respectively.

As used herein, the phrase "a property of the modified terpene synthase is improved compared to the first terpene synthase" refers to a desirable change in a property of a modified terpene synthase compared to a terpene synthase that does not contain the modification(s). Typically, the property or properties are improved such that the amount of a desired terpene produced from the reaction of a substrate with the modified terpene synthase is increased compared to the amount of the desired terpene produced from the reaction of a substrate with a terpene synthase that is not so modified. Exemplary properties that can be improved in a modified terpene synthase include, for example, terpene production, catalytic activity, product distribution, substrate specificity, regioselectivity and stereoselectivity. One or more of the properties can be assessed using methods well known in the art to determine whether the property had been improved (i.e. has been altered to be more desirable for the production of a desired terpene or terpenes).

As used herein, terpene productions (also referred to as terpene yield) refers to the amount (in weight or weight/volume) of terpene produced from the reaction of an acyclic pyrophosphate terpene precursor with a terpene synthase. Reference to total terpene production refers to the total amount of all terpenes produced from the reaction, while reference to specific terpene production refers to the amount of a specific terpene (e.g. valencene), produced from the reaction.

As used herein, an improved terpene production refers to an increase in the total amount of terpene (i.e. improved total terpene production) or an increase in the specific amount of terpene (i.e. improved specific terpene production) produced from the reaction of an acyclic pyrophosphate terpene precursor with a modified terpene synthase compared to the amount produced from the reaction of the same acyclic pyrophosphate terpene precursor with a terpene synthase that is not so modified. The amount of terpene (total or specific) produced from the reaction of an acyclic pyrophosphate terpene precursor with a modified terpene synthase can be increased by at least or at least about 5%, 10%, 15%, 20%, 30%, 40%, 50%, 60%, 70%, 80%, 90%, 100% or more compared to the amount of terpene produced from the reaction of the same acyclic pyrophosphate terpene precursor under the same conditions with a terpene synthase that is not so modified.

As used herein, substrate specificity refers to the preference of a valencene synthase for one target substrate over another, such as one acyclic pyrophosphate terpene precursor (e.g. farnesyl-pyrophosphate (FPP), geranyl-pyrophosphate (GPP), or geranylgeranyl-pyrophosphate (GGPP)) over another. Substrate specificity can be assessed using methods well known in the art, such as those that calculate $k_{cat}/K_m$. For example, the substrate specificity can be assessed by comparing the relative Kcat/Km, which is a measure of catalytic efficiency, of the enzyme against various substrates (e.g. GPP, FPP, GGPP).

As used herein, altered specificity refers to a change in substrate specificity of a modified terpene synthase polypeptide (such as a modified valencene synthase polypeptide) compared to a terpene synthase that is not so modified (such as, for example, a wild-type valencene synthase). The specificity (e.g. $k_{cat}/K_m$) of a modified terpene synthase polypeptide for a substrate, such as FPP, GPP or GGPP, can be altered by at least or at least about 10%, 15%, 20%, 30%, 40%, 50%, 60%, 70%, 80%, 90%, 100% or more compared to the specificity of a starting valencene synthase for the same substrate.

As used herein, improved substrate specificity refers to a change or alteration in the substrate specificity to a more desired specificity. For example, an improved substrate specificity can include an increase in substrate specificity of a modified terpene synthase polypeptide for a desired substrate, such as FPP, GPP or GGPP. The specificity (e.g. $k_{cat}/K_m$) of a modified terpene synthase polypeptide for a substrate, such as FPP, GPP or GGPP, can be increased by at least or at least about 10%, 15%, 20%, 30%, 40%, 50%, 60%, 70%, 80%, 90%, 100% or more compared to the specificity of a terpene synthase that is not so modified.

As used herein, "product distribution" refers to the relative amounts of different terpenes produced from the reaction between an acyclic pyrophosphate terpene precursor, such as FPP, and a terpene synthase, including the modified valencene synthase polypeptides provided herein. The amount of a produced terpene can be depicted as a percentage of the total products produced by the terpene synthase. For example, the product distribution resulting from reaction of FPP with a valencene synthase can be 90% (weight/volume) valencene and 10% (weight/volume) germacrene A. Methods for assessing the type and amount of a terpene in a solution are well known in the art and described herein, and include, for example, gas chromatography-mass spectrometry (GC-MS) (see Examples below).

As used herein, an altered product distribution refers to a change in the relative amount of individual terpenes produced from the reaction between an acyclic pyrophosphate terpene precursor, such as FPP, and a terpene synthase, such as valencene synthase. Typically, the change is assessed by determining the relative amount of individual terpenes produced from the acyclic pyrophosphate terpene precursor using a first synthase (e.g. wild-type synthase) and then comparing it to the relative amount of individual terpenes produced using a second synthase (e.g. a modified synthase). An altered product distribution is considered to occur if the relative amount of any one or more terpenes is increased or decreased by at least or by at least about 0.5%, 1%, 2%, 3%, 4%, 5%, 6%, 7%, 8%, 9%, 10%, 15%, 20%, 25%, 30%, 35%, 40%, 50%, 60%, 70%, 80% or more.

As used herein, an improved product distribution refers to a change in the product distribution to one that is more desirable, i.e. contains more desirable relative amounts of terpenes. For example, an improved product distribution can contain an increased amount of a desired terpene and a decreased amount of a terpene that is not so desired. The amount of desired terpene in an improved production distribution can be increased by at least or by at least about 0.5%, 1%, 2%, 3%, 4%, 5%, 6%, 7%, 8%, 9%, 10%, 15%, 20%, 25%, 30%, 35%, 40%, 50%, 60%, 70%, 80% or more. The amount of a terpene that is not desired in an improved production distribution can be decreased by at least or by at least about 0.5%, 1%, 2%, 3%, 4%, 5%, 6%, 7%, 8%, 9%, 10%, 15%, 20%, 25%, 30%, 35%, 40%, 50%, 60%, 70%, 80% or more.

As used herein, nucleic acids or nucleic acid molecules include DNA, RNA and analogs thereof, including peptide nucleic acids (PNA) and mixtures thereof. Nucleic acids can be single or double-stranded. When referring to probes or primers, which are optionally labeled, such as with a detectable label, such as a fluorescent or radiolabel, single-stranded molecules are contemplated. Such molecules are typically of a length such that their target is statistically unique or of low copy number (typically less than 5, generally less than 3) for probing or priming a library. Generally a probe or primer contains at least 14, 16 or 30 contiguous nucleotides of sequence complementary to or identical to a gene of interest. Probes and primers can be 10, 20, 30, 50, 100 or more nucleic acids long.

As used herein, the term polynucleotide means a single- or double-stranded polymer of deoxyribonucleotides or ribonucleotide bases read from the 5' to the 3' end. Polynucleotides include RNA and DNA, and can be isolated from natural sources, synthesized in vitro, or prepared from a combination of natural and synthetic molecules. The length of a polynucleotide molecule is given herein in terms of nucleotides (abbreviated "nt") or base pairs (abbreviated "bp"). The term nucleotides is used for single- and double-stranded molecules where the context permits. When the term is applied to double-stranded molecules it is used to denote overall length and will be understood to be equivalent to the term base pairs. It will be recognized by those skilled in the art that the two strands of a double-stranded polynucleotide can differ slightly in length and that the ends thereof can be staggered; thus all nucleotides within a double-stranded polynucleotide molecule can not be paired. Such unpaired ends will, in general, not exceed 20 nucleotides in length.

As used herein, heterologous nucleic acid is nucleic acid that is not normally produced in vivo by the cell in which it is expressed or that is produced by the cell but is at a different locus or expressed differently or that mediates or encodes mediators that alter expression of endogenous nucleic acid, such as DNA, by affecting transcription, translation, or other regulatable biochemical processes. Heterologous nucleic acid is generally not endogenous to the cell into which it is introduced, but has been obtained from another cell or prepared synthetically. Heterologous nucleic acid can be endogenous, but is nucleic acid that is expressed from a different locus or altered in its expression. Generally, although not necessarily, such nucleic acid encodes RNA and proteins that are not normally produced by the cell or in the same way in the cell in which it is expressed. Heterologous nucleic acid, such as DNA, also can be referred to as foreign nucleic acid, such as DNA. Thus, heterologous nucleic acid or foreign nucleic acid includes a nucleic acid molecule not present in the exact orientation or position as the counterpart nucleic acid molecule, such as DNA, is found in a genome. It also can refer to a nucleic acid molecule from another organism or species (i.e., exogenous).

Any nucleic acid, such as DNA, that one of skill in the art would recognize or consider as heterologous or foreign to the cell in which the nucleic acid is expressed is herein encompassed by heterologous nucleic acid; heterologous nucleic acid includes exogenously added nucleic acid that also is expressed endogenously. Examples of heterologous nucleic acid include, but are not limited to, nucleic acid that encodes traceable marker proteins, such as a protein that confers drug resistance, nucleic acid that encodes therapeutically effective substances, such as anti-cancer agents, enzymes and hormones, and nucleic acid, such as DNA, that encodes other types of proteins, such as antibodies. Antibodies that are encoded by heterologous nucleic acid can be secreted or expressed on the surface of the cell in which the heterologous nucleic acid has been introduced.

As used herein, a peptide refers to a polypeptide that is from 2 to 40 amino acids in length.

As used herein, the amino acids that occur in the various sequences of amino acids provided herein are identified according to their known, three-letter or one-letter abbreviations (Table 1). The nucleotides which occur in the various nucleic acid fragments are designated with the standard single-letter designations used routinely in the art.

As used herein, an "amino acid" is an organic compound containing an amino group and a carboxylic acid group. A polypeptide contains two or more amino acids. For purposes herein, amino acids include the twenty naturally-occurring amino acids, non-natural amino acids and amino acid analogs (i.e., amino acids wherein the α-carbon has a side chain).

In keeping with standard polypeptide nomenclature described in *J. Biol. Chem.,* 243: 3557-3559 (1968), and adopted in 37 C.F.R. §§1.821-1.822, abbreviations for the amino acid residues are shown in Table 1:

TABLE 1

Table of Correspondence

| SYMBOL | | |
|---|---|---|
| 1-Letter | 3-Letter | AMINO ACID |
| Y | Tyr | Tyrosine |
| G | Gly | Glycine |
| F | Phe | Phenylalanine |
| M | Met | Methionine |

TABLE 1-continued

| Table of Correspondence | | |
|---|---|---|
| SYMBOL | | |
| 1-Letter | 3-Letter | AMINO ACID |
| A | Ala | Alanine |
| S | Ser | Serine |
| I | Ile | Isoleucine |
| L | Leu | Leucine |
| T | Thr | Threonine |
| V | Val | Valine |
| P | Pro | Proline |
| K | Lys | Lysine |
| H | His | Histidine |
| Q | Gln | Glutamine |
| E | Glu | Glutamic acid |
| Z | Glx | Glu and/or Gln |
| W | Trp | Tryptophan |
| R | Arg | Arginine |
| D | Asp | Aspartic acid |
| N | Asn | Asparagine |
| B | Asx | Asn and/or Asp |
| C | Cys | Cysteine |
| X | Xaa | Unknown or other |

It should be noted that all amino acid residue sequences represented herein by formulae have a left to right orientation in the conventional direction of amino-terminus to carboxyl-terminus. In addition, the phrase "amino acid residue" is broadly defined to include the amino acids listed in the Table of Correspondence (Table 1) and modified and unusual amino acids, such as those referred to in 37 C.F.R. §§1.821-1.822, and incorporated herein by reference. Furthermore, it should be noted that a dash at the beginning or end of an amino acid residue sequence indicates a peptide bond to a further sequence of one or more amino acid residues, to an amino-terminal group such as $NH_2$ or to a carboxyl-terminal group such as COOH.

As used herein, "naturally occurring amino acids" refer to the 20 L-amino acids that occur in polypeptides.

As used herein, "non-natural amino acid" refers to an organic compound containing an amino group and a carboxylic acid group that is not one of the naturally-occurring amino acids listed in Table 1. Non-naturally occurring amino acids thus include, for example, amino acids or analogs of amino acids other than the 20 naturally-occurring amino acids and include, but are not limited to, the D-isostereomers of amino acids. Exemplary non-natural amino acids are known to those of skill in the art and can be included in a modified valencene synthase polypeptides provided herein.

As used herein, modification is in reference to modification of a sequence of amino acids of a polypeptide or a sequence of nucleotides in a nucleic acid molecule and includes deletions, insertions, and replacements of amino acids and nucleotides, respectively. For purposes herein, amino acid replacements (or substitutions), deletions and/or insertions, can be made in any of the valencene synthases provided herein. Modifications can be made by making conservative amino acid replacements and also non-conservative amino acid substitutions. For example, amino acid replacements that desirably or advantageously alter properties of the valencene synthase can be made. For example, amino acid replacements can be made to the valencene synthase such that the resulting modified valencene synthase can produce more valencene from FPP compared to an unmodified valencene synthase.

Amino acid replacements or substitutions contemplated include conservative substitutions, including, but not limited to, those set forth in Table 2. Suitable conservative substitutions of amino acids are known to those of skill in the art and can be made generally without altering the conformation or activity of the polypeptide. Those of skill in this art recognize that, in general, single amino acid substitutions in non-essential regions of a polypeptide do not substantially alter biological activity (see, e.g., Watson et al. *Molecular Biology of the Gene,* 4th Edition, 1987, The Benjamin/Cummings Pub. co., p. 224). Conservative amino acid substitutions are made, for example, in accordance with those set forth in Table 2 as follows:

TABLE 2

| Original residue | Conservative substitution |
|---|---|
| Ala (A) | Gly; Ser; Abu |
| Arg (R) | Lys; orn |
| Asn (N) | Gln; His |
| Cys (C) | Ser |
| Gln (Q) | Asn |
| Glu (E) | Asp |
| Gly (G) | Ala; Pro |
| His (H) | Asn; Gln |
| Ile (I) | Leu; Val |
| Leu (L) | Ile; Val |
| Lys (K) | Arg; Gln; Glu |
| Met (M) | Leu; Tyr; Ile |
| Ornithine | Lys; Arg |
| Phe (F) | Met; Leu; Tyr |
| Ser (S) | Thr |
| Thr (T) | Ser |
| Trp (W) | Tyr |
| Tyr (Y) | Trp; Phe |
| Val (V) | Ile; Leu; Met |

Other conservative substitutions also are permissible and can be determined empirically or in accord with known conservative substitutions. The effects of such substitutions can be calculated using substitution score matrices such PAM120, PAM-200, and PAM-250 as discussed in Altschul (*J. Mol. Biol.* 219: 555-65 (1991)).

As used herein, "primary sequence" refers to the sequence of amino acid residues in a polypeptide.

As used herein, "similarity" between two proteins or nucleic acids refers to the relatedness between the sequence of amino acids of the proteins or the nucleotide sequences of the nucleic acids. Similarity can be based on the degree of identity and/or homology of sequences of residues and the residues contained therein. Methods for assessing the degree of similarity between proteins or nucleic acids are known to those of skill in the art. For example, in one method of assessing sequence similarity, two amino acid or nucleotide sequences are aligned in a manner that yields a maximal level of identity between the sequences. "Identity" refers to the extent to which the amino acid or nucleotide sequences are invariant. Alignment of amino acid sequences, and to some extent nucleotide sequences, also can take into account conservative differences and/or frequent substitutions in amino acids (or nucleotides). Conservative differences are those that preserve the physico-chemical properties of the residues involved. Alignments can be global (alignment of the compared sequences over the entire length of the sequences and including all residues) or local (the alignment of a portion of the sequences that includes only the most similar region or regions).

As used herein, the terms "homology" and "identity" are used to describe relatedness between and among polypeptides (or encoding nucleic acid molecules). Identity refers to identical sequences; homology can include conservative amino acid changes. In general to identify corresponding positions the sequences of amino acids are aligned so that the highest order match is obtained (see, e.g.: *Computational Molecular Biology*, Lesk, A. M., ed., Oxford University Press, New York, 1988; *Biocomputing: Informatics and Genome Projects*, Smith, D. W., ed., Academic Press, New York, 1993; *Computer Analysis of Sequence Data, Part* I, Griffin, A. M., and Griffin, H. G., eds., Humana Press, New Jersey, 1994; *Sequence Analysis in Molecular Biology*, von Heinje, G., Academic Press, 1987; and *Sequence Analysis Primer*, Gribskov, M. and Devereux, J., eds., M Stockton Press, New York, 1991; Carillo et al. (1988) *SIAM J Applied Math* 48:1073).

As use herein, "sequence identity" refers to the number of identical amino acids (or nucleotide bases) in a comparison between a test and a reference polypeptide or polynucleotide. Homologous polypeptides refer to two or more peptides that have a pre-determined number of identical or conservative amino acid residues. Homology also includes substitutions that do not change the encoded amino acid (i.e. "silent substitutions"). Sequence identity can be determined by standard alignment algorithm programs used with default gap penalties established by each supplier. Homologous nucleic acid molecules refer to two or more nucleotides that have a pre-determined number of identical or homologous nucleotides. Substantially homologous nucleic acid molecules hybridize typically at moderate stringency or at high stringency all along the length of the nucleic acid or along at least about 70%, 80% or 90% of the full-length nucleic acid molecule of interest. Also contemplated are nucleic acid molecules that contain degenerate codons in place of codons in the hybridizing nucleic acid molecule. (For determination of homology of proteins, conservative amino acids can be aligned as well as identical amino acids; in this case, percentage of identity and percentage homology varies). Whether any two nucleic acid molecules have nucleotide sequences (or any two polypeptides have amino acid sequences) that are at least 80%, 85%, 90%, 95%, 96%, 97%, 98% or 99% "identical" can be determined using known computer algorithms such as the "FAST A" program, using for example, the default parameters as in Pearson et al. *Proc. Natl. Acad. Sci. USA* 85: 2444 (1988) (other programs include the GCG program package (Devereux, J., et al., *Nucleic Acids Research* 12(I): 387 (1984)), BLASTP, BLASTN, FASTA (Atschul, S. F., et al., *J. Molec. Biol.* 215:403 (1990); *Guide to Huge Computers*, Martin J. Bishop, ed., Academic Press, San Diego (1994), and Carillo et al. *SIAM J Applied Math* 48: 1073 (1988)). For example, the BLAST function of the National Center for Biotechnology Information database can be used to determine identity. Other commercially or publicly available programs include DNAStar "MegAlign" program (Madison, Wis.) and the University of Wisconsin Genetics Computer Group (UWG) "Gap" program (Madison Wis.)). Percent homology or identity of proteins and/or nucleic acid molecules can be determined, for example, by comparing sequence information using a GAP computer program (e.g., Needleman et al. *J. Mol. Biol.* 48: 443 (1970), as revised by Smith and Waterman (*Adv. Appl. Math.* 2: 482 (1981)). Briefly, a GAP program defines similarity as the number of aligned symbols (i.e., nucleotides or amino acids) which are similar, divided by the total number of symbols in the shorter of the two sequences. Default parameters for the GAP program can include: (1) a unary comparison matrix (containing a value of 1 for identities and 0 for non identities) and the weighted comparison matrix of Gribskov et al. *Nucl. Acids Res.* 14: 6745 (1986), as described by Schwartz and Dayhoff, eds., *Atlas of Protein Sequence and Structure*, National Biomedical Research Foundation, pp. 353-358 (1979); (2) a penalty of 3.0 for each gap and an additional 0.10 penalty for each symbol in each gap; and (3) no penalty for end gaps. Clustal analysis also can be used to align either nucleotide or protein sequences and to score their level of identity and similarity (available at ebi.ac.uk/Tools/msa/clusalw2/or ebi.ac.uk/ebi-search/search.ebi?db=medline&t=clustal*).

Therefore, as used herein, the term "identity" represents a comparison between a test and a reference polypeptide or polynucleotide. In one non-limiting example, "at least 90% identical to" refers to percent identities from 90 to 100% relative to the reference polypeptides. Identity at a level of 90% or more is indicative of the fact that, assuming for exemplification purposes a test and reference polypeptide length of 100 amino acids are compared, no more than 10% (i.e., 10 out of 100) of amino acids in the test polypeptide differs from that of the reference polypeptides. Similar comparisons can be made between a test and reference polynucleotides. Such differences can be represented as point mutations randomly distributed over the entire length of an amino acid sequence or they can be clustered in one or more locations of varying length up to the maximum allowable, e.g., 10/100 amino acid difference (approximately 90% identity). Differences are defined as nucleic acid or amino acid substitutions, insertions or deletions. At the level of homologies or identities above about 85-90%, the result should be independent of the program and gap parameters set; such high levels of identity can be assessed readily, often without relying on software.

As used herein, it also is understood that the terms "substantially identical" or "similar" varies with the context as understood by those skilled in the relevant art, but that those of skill can assess such.

As used herein, an aligned sequence refers to the use of homology (similarity and/or identity) to align corresponding positions in a sequence of nucleotides or amino acids. Typically, two or more sequences that are related by 50% or more identity are aligned. An aligned set of sequences refers to 2 or more sequences that are aligned at corresponding positions and can include aligning sequences derived from RNAs, such as ESTs and other cDNAs, aligned with genomic DNA sequence.

As used herein, isolated or purified polypeptide or protein or biologically-active portion thereof is substantially free of cellular material or other contaminating proteins from the cell of tissue from which the protein is derived, or substantially free from chemical precursors or other chemicals when chemically synthesized. Preparations can be determined to be substantially free if they appear free of readily detectable impurities as determined by standard methods of analysis, such as thin layer chromatography (TLC), gel electrophoresis and high performance liquid chromatography (HPLC), used by those of skill in the art to assess such purity, or sufficiently pure such that further purification would not detectably alter the physical and chemical properties, such as proteolytic and biological activities, of the substance. Methods for purification of the compounds to produce substantially chemically pure compounds are known to those of skill in the art. A substantially chemically pure compound, however, can be a mixture of stereoisomers. In such instances, further purification might increase the specific activity of the compound.

The term substantially free of cellular material includes preparations of valencene synthase or terpene products in which the valencene synthase or terpene is separated from cellular components of the cells from which it is isolated or produced. In one embodiment, the term substantially free of cellular material includes preparations of valencene synthase or terpene products having less than about 30%, 20%, 10%, 5% or less (by dry weight) of non-valencene synthase or terpene proteins or products, including cell culture medium.

As used herein, production by recombinant methods by using recombinant DNA methods refers to the use of the well known methods of molecular biology for expressing proteins encoded by cloned DNA.

As used herein, vector (or plasmid) refers to discrete DNA elements that are used to introduce heterologous nucleic acid into cells for either expression or replication thereof. The vectors typically remain episomal, but can be designed to effect integration of a gene or portion thereof into a chromosome of the genome. Also contemplated are vectors that are artificial chromosomes, such as bacterial artificial chromosomes, yeast artificial chromosomes and mammalian artificial chromosomes. Selection and use of such vehicles are well known to those of skill in the art.

As used herein, expression refers to the process by which nucleic acid is transcribed into mRNA and translated into peptides, polypeptides, or proteins. If the nucleic acid is derived from genomic DNA, expression can, if an appropriate eukaryotic host cell or organism is selected, include processing, such as splicing of the mRNA.

As used herein, an expression vector includes vectors capable of expressing DNA that is operatively linked with regulatory sequences, such as promoter regions, that are capable of effecting expression of such DNA fragments. Such additional segments can include promoter and terminator sequences, and optionally can include one or more origins of replication, one or more selectable markers, an enhancer, a polyadenylation signal, and the like. Expression vectors are generally derived from plasmid or viral DNA, or can contain elements of both. Thus, an expression vector refers to a recombinant DNA or RNA construct, such as a plasmid, a phage, recombinant virus or other vector that, upon introduction into an appropriate host cell, results in expression of the cloned DNA. Appropriate expression vectors are well known to those of skill in the art and include those that are replicable in eukaryotic cells and/or prokaryotic cells and those that remain episomal or those which integrate into the host cell genome.

As used herein, vector also includes "virus vectors" or "viral vectors." Viral vectors are engineered viruses that are operatively linked to exogenous genes to transfer (as vehicles or shuttles) the exogenous genes into cells.

As used herein, an adenovirus refers to any of a group of DNA-containing viruses that cause conjunctivitis and upper respiratory tract infections in humans.

As used herein, naked DNA refers to histone-free DNA that can be used for vaccines and gene therapy. Naked DNA is the genetic material that is passed from cell to cell during a gene transfer process called transformation or transfection. In transformation or transfection, purified or naked DNA that is taken up by the recipient cell will give the recipient cell a new characteristic or phenotype.

As used herein, operably or operatively linked when referring to DNA segments means that the segments are arranged so that they function in concert for their intended purposes, e.g., transcription initiates in the promoter and proceeds through the coding segment to the terminator.

As used herein, a "chimeric protein" or "fusion protein" refers to a polypeptide operatively-linked to a different polypeptide. A chimeric or fusion protein provided herein can include one or more valencene synthase polypeptides, or a portion thereof, and one or more other polypeptides for any one or more of a transcriptional/translational control signals, signal sequences, a tag for localization, a tag for purification, part of a domain of an immunoglobulin G, and/or a targeting agent. A chimeric valencene synthase polypeptide also includes those having their endogenous domains or regions of the polypeptide exchanged with another polypeptide. These chimeric or fusion proteins include those produced by recombinant means as fusion proteins, those produced by chemical means, such as by chemical coupling, through, for example, coupling to sulfhydryl groups, and those produced by any other method whereby at least one polypeptide (i.e. valencene synthase), or a portion thereof, is linked, directly or indirectly via linker(s) to another polypeptide.

As used herein, recitation that a polypeptide "consists essentially" of a recited sequence of amino acids means that only the recited portion, or a fragment thereof, of the full-length polypeptide is present. The polypeptide can optionally, and generally will, include additional amino acids from another source or can be inserted into another polypeptide As used herein, the singular forms "a," "an" and "the" include plural referents unless the context clearly dictates otherwise. Thus, for example, reference to a polypeptide comprising "an amino acid replacement" includes polypeptides with one or a plurality of amino acid replacements.

As used herein, ranges and amounts can be expressed as "about" a particular value or range. About also includes the exact amount. Hence "about 5%" means "about 5%" and also "5%."

As used herein, "optional" or "optionally" means that the subsequently described event or circumstance does or does not occur, and that the description includes instances where said event or circumstance occurs and instances where it does not. For example, an optional step of isolating valencene means that the valencene is isolated or is not isolated.

As used herein, the abbreviations for any protective groups, amino acids and other compounds, are, unless indicated otherwise, in accord with their common usage, recognized abbreviations, or the IUPAC-IUB Commission on Biochemical Nomenclature (see, (1972) *Biochem.* 11:1726).

B. Valencene Synthase

Valencene synthases are class 1 plant terpene cyclases, or terpene synthases, isoprenoid synthases or terpenoid cyclases, which convert farnesyl diphosphate into the sesquiterpene valencene. Valencene can then be converted to nootkatone by oxidation. Both valencene and nootkatone are natural constituents of citrus oils, such as orange and grapefruit, and are widely used ingredients in perfumery and the flavor industry.

Valencene has been identified in citrus fruit, grapevine flowers, celery (*Apium graveolens*), mango (*Mangifera indica*), olives (*Olea europea*) and coral. To date, valencene synthases have been isolated from citrus fruit, grapevine flowers and *perilla* (green shiso). Citrus valencene synthase (CVS) has been identified in the flavedo (outer peel) of *Citrus sinensis* (Sweet orange) (SEQ ID NOS:2, 289, 290) and *Citrus x paradisi* (Grapefruit) (SEQ ID NOS:291 and 752) (see, Chappell (2004) Trends Plant Sci., 9:266; Sharon-Asa et al., (2003) *The Plant Journal* 36:664-674; AF411120 and U.S. Pat. Nos. 7,273,735; 7,442,785; 7,790,426; and International PCT Appl. No. WO2005021705 and WO2003025193). A variant valencene synthase has been described containing amino acid replacements A517I/I518V (Eyal, E. Masters Thesis, Department of Plant Sciences, Weizmann Institute of Science, Rehovot, Israel; January, 2001; set forth in SEQ ID NO:886). Valencene synthases have also been identified and isolated from grapevine flowers, including *Vitis vinifera* L. cv. Gewürztraminer and. *Vitis vinifera* L. cv. Cabernet Sauvignon (see, Lucker et al., (2004) *Phytochemistry* 65(19):2649-59 and Martin et al., (2009) *Proc. Natl. Acad. Sci, USA* 106: 7245-7250) (SEQ ID NOS:346 and 347). Valencene synthases also have been isolated from *Chamaecyparis nootkatensis pendula* (see e.g. International PCT Appl. No. WO2011074954; SEQ ID NOS: 882 and 883, and encoding nucleic acids set forth in SEQ ID NOS: 884 and 885, respectively).

1. Structure

Class 1 plant terpene cyclases include a diverse group of monomeric terpene synthases that share a common alpha helical architecture termed the class 1 terpenoid cyclase fold (see, e.g., Christianson, D. W., (2008) *Curr Opin Chem Biol* 12(2):141-150 and Bohlmann et al., (1998) *Proc. Natl. Acad. Sci. USA* 95:4126-4133). Although relatively little overall sequence similarity exists, class 1 plant terpene cyclases have homologous structures and some highly conserved motifs and/or residues. In its catalytic site, each terpene cyclase provides a template that binds the flexible isoprenoid substrate with an orientation and conformation such that upon cyclization, a specific intramolecular carbon-carbon bond is formed. Thus, the structure of each enzyme's catalytic site dictates the resulting cyclic monoterpenes, diterpenes and sesquiterpenes.

X-ray crystal structures of tobacco 5-epi-aristolochene synthase and pentalenene synthase revealed that class 1 plant terpene cyclases consist entirely of alpha helices interconnected by short connecting loops and turns (see, e.g., Starks et al., (1997), *Science* 277:1815-1820 and Lesburg et al., (1997), *Science* 277:1820-1824; see also FIGS. 2A-C). These enzymes contain two distinct structural domains, an N-terminal domain, whose structure resembles catalytic cores of glycosyl hydrolysases but whose function remains largely unknown, and a C-terminal catalytic domain. The catalytic domain contains two conserved metal binding motifs, i.e., aspartate-rich regions, which are responsible for enzyme catalytic activity. The catalytic site contains a large central cavity formed by mostly antiparallel alpha helices with the two aspartate-rich regions located on opposite walls. The aspartate-rich regions mediate binding of substrate diphosphates via bridging $Mg^{2+}$ ions. Subsequent binding of the substrate induces conformational changes such that the N-terminal region forms a cap over the catalytic core that closes the active site to solvent, thereby stabilizing the reactive carbocation intermediates.

Conserved alpha helices C, D, F, G and H make up the catalytic or active site of class 1 plant terpene synthases. The active site is a hydrophobic pocket lined by aromatic residues to accommodate the olefin chain of the substrate. The aromatic residues stabilize carbocation intermediates through π-cation interactions. Aspartate-rich region 1 is located on Helix D and is characterized by conserved sequence DDxxD, which also functions to bind $Mg^{2+}$ (see, e.g., Starks et al., (1997), *Science* 277:1815-1820). A second conserved metal-binding region is located on Helix H and is characterized by the conserved sequence [N/D]xxx[S/T]xxxE, also referred to as the "NSE/DTE motif" These two conserved metal binding motifs coordinate the binding of three $Mg^{2+}$ ions to the isoprenoid disphosphate.

2. Function

Valencene synthase catalyzes the formation of valencene from the ubiquitous pyrophosphate intermediate farnesyl diphosphate (FPP), which is produced as part of the mevalonate-dependent isoprenoid biosynthetic pathway in fungi and animals and the non-mevalonate-dependent isoprenoid biosynthetic pathway in bacteria and higher plants. Valencene (1,2,3,5,6,7,8,8a-octahydro-7-isopropenyl-1,8a-dimethyl-naphthalene) is then converted by oxidation to nootkatone (4,4a,5,6,7,8-hexahydro-6-isopropenyl-4,4-a-dimethyl-2 (3H)-naphthalenone). FIG. 3 depicts the biochemical pathway.

Class 1 plant terpene cyclases such as valencene synthase are metal dependent cyclases that convert linear all-trans isoprenoid diphosphates, such as geranyl diphosphate, farnesyl diphosphate and geranyl-geranyl diphosphate, into cyclic monoterpenes, diterpenes and sesquiterpenes. Cyclization reactions proceed via electrophilic alkylation in which new carbon-carbon single bonds are formed through reaction of a highly reactive electron-deficient allylic carbocation and an electron-rich carbon-carbon double bond.

Terpene synthases contain divalent metal ions, typically $Mg^{2+}$ ions or sometimes $Mn^{2+}$, at the active center of the enzyme that are required for enzyme catalysis. More specifically, they are required for pyrophosphate departure. Generally, the enzymes contain two conserved metal binding motifs that line the catalytic site, including the aspartate-rich DDxxD motif that coordinates binding of two $Mg^{2+}$ ions and the NSE/DTE motif that coordinates a third $Mg^{2+}$ ion (see, Starks et al., (1997), *Science* 277:1815-1820 and Lesburg et al., (1997), *Science* 277:1820-1824). The aspartate-rich regions of the catalytic active site mediate binding of prenyl diphosphates via bridging $Mg^{2+}$ ions. Binding of $(Mg^{2+})_3$-$PP_i$ induces conformational changes such that the N-terminal region forms a cap over the catalytic core and therefore stabilizes the active site in a closed conformation that is free from bulk solvent. Loss of pyrophosphate ($PP_i$) from the enzyme-bound substrate results in a highly reactive allylic carbocation that electrophilically attacks an intramolecular double bond further down the terpene chain to effect ring closure. The $PP_i$ anion accepts hydrogen bonds from conserved basic residues when bound in the closed synthase conformation and a hydrophobic pocket lined by aromatic residues cradles the prenyl side chain and likely templates the cyclization reaction by enforcing particular substrate conformations and stabilizing carbocations through π-stacking interactions (Noel et al., (2010) *ACS Chemical Biology* 5(4): 377-392).

3. Citrus valancene sythanse

Citrus valencene synthase is a sesquiterpene synthase found in citrus fruit, such as oranges and grapefruit, which converts all-trans farnesyl diphosphate (FPP) into the sesquiterpene valencene. Several citrus valencene synthases have been identified and isolated to date. The amino acid sequences of the citrus valencene synthases are not necessarily species-specific, as synthases isolated from a particular species (e.g. *Citrus sinensis*) can have the same or different sequence to that of another synthase isolated from the same species, and can have the same or different sequence as a synthase isolated from a different species (e.g. *Citrus paradisi*).

Citrus valencene synthases isolated and sequenced to date include the valencene synthase isolated from *Citrus sinensis* cv. Valencia (Valencia orange) as described herein (see Example 1), which is a 548 amino acid polypeptide having an amino acid sequence set forth in SEQ ID NO:2 (encoded by the cDNA sequence set forth in SEQ ID NO:1). This synthase shares 100% nucleotide sequence identity with a valencene synthase isolated from *Citrus paradisi* (grapefruit: see U.S. Pat. No. 7,273,735) and with a valencene synthase isolated from the navel orange (*Citrus sinensis* cv. Cara Cara; Genbank Accession Nos. ACX70155). The nucleotide sequence that describes all three of these terpene synthases is set forth in SEQ ID NO:1 (also Genbank Accession No. GQ988384). The corresponding polypeptide amino acid sequence is set forth in SEQ ID NO:2 A second valence synthase from *Citrus*

*paradisi* also is described in U.S. Pat. No. 7,273,735 that contains 4 amino acid substitutions compared to the valencene synthase set forth in SEQ ID NO:2; 192N, D9511, R98S and A99P (SEQ ID NO:752, encoded by the cDNA set forth in SEQ ID NO:753). Another valencene synthase isolated from the flavedo (outer peel) of *Citrus sinensis* cv. Valencia has 2 amino acid substitutions compared to the valencene synthase set forth in SEQ ID NO:2; V123G and Y221C (SEQ ID NO:289, encoded by the cDNA set forth in SEQ ID NO:292; Genbank Accession Nos. AAQ04608 and AF441124; see, Sharon-Asa et al., (2003) The Plant Journal 36:664-674). A further valencene synthase isolated from *Citrus x paradisi* has 2 different amino acid substitutions compared to the valencene synthase set forth in SEQ ID NO:2; Q87L and L239P (SEQ ID NO:290, encoded by the cDNA set forth in SEQ ID NO:293; see, U.S. Pat. No. 7,442,785); and another valencene synthase isolated from *Citrus x paradisi* a further (for a total of 3) amino acid substitutions compared to the valencene synthase set forth in SEQ ID NO:2; Q87L, L239P and N493D (SEQ ID NO:291, encoded by the cDNA set forth in SEQ ID NO:294; see, Genbank Accession Nos. AAM00426 and AF411120).

As described above, citrus valencene synthase contains an N-terminal domain (aa 1-266 of SEQ ID NO:2) and a C-terminal catalytic domain (aa 267-548 of SEQ ID NO:2). Although valencene synthase does not necessarily share a high percentage of homology to other terpene synthases, the catalytic domain does share a common 3-dimensional structure (described in, for example, U.S. Pat. Nos. 6,465,772, 6,495,354 and 6,559,297) with other terpene synthases. When aligned and compared with the structure of tobacco 5-epi-aristolochene synthase (TEAS; described in Starks et al. (1999) *Science* 277:1815-1820), it is apparent that Citrus valencene synthase contains the following structural domains: unstructured loop 1 (corresponding to amino acids 1-29 of SEQ ID NO:2); alpha helix 1 (corresponding to amino acids 30-39 and 44-52 of SEQ ID NO:2); unstructured loop 2 (corresponding to amino acids 53-58 of SEQ ID NO:2); alpha helix 2 (corresponding to amino acids 59-71 of SEQ ID NO:2); unstructured loop 3 (corresponding to amino acids 72-78 of SEQ ID NO:2); alpha helix 3 (corresponding to amino acids 79-93 of SEQ ID NO:2); unstructured loop 4 (corresponding to amino acids 94-100 of SEQ ID NO:2); alpha helix 4 (corresponding to amino acids 101-114 of SEQ ID NO:2); unstructured loop 5 (corresponding to amino acids 115-141 of SEQ ID NO:2); alpha helix 5 (corresponding to amino acids 142-152 of SEQ ID NO:2); unstructured loop 6 (corresponding to amino acids 153-162 of SEQ ID NO:2); alpha helix 6 (corresponding to amino acids 163-173 of SEQ ID NO:2); unstructured loop 7 (corresponding to amino acids 174-184 of SEQ ID NO:2); alpha helix 7 (corresponding to amino acids 185-194 of SEQ ID NO:2); unstructured loop 8 (corresponding to amino acids 195-201 of SEQ ID NO:2); alpha helix 8 (corresponding to amino acids 202-212 of SEQ ID NO:2); unstructured loop 9 (corresponding to amino acids 213-222 of SEQ ID NO:2); alpha helix A (corresponding to amino acids 223-253 of SEQ ID NO:2); A-C loop (corresponding to amino acids 254-266 of SEQ ID NO:2); alpha helix C (corresponding to amino acids 267-276 of SEQ ID NO:2); unstructured loop 11 (corresponding to amino acids 277-283 of SEQ ID NO:2); alpha helix D (corresponding to amino acids 284-305 of SEQ ID NO:2); unstructured loop 12 (corresponding to amino acids 306-309 of SEQ ID NO:2); alpha helix D1 (corresponding to amino acids 310-322 of SEQ ID NO:2); unstructured loop 13 (corresponding to amino acids 323-328 of SEQ ID NO:2); alpha helix D2 (corresponding to amino acids 329 of SEQ ID NO:2); unstructured loop 14 (corresponding to amino acids 330-332 of SEQ ID NO:2); alpha helix E (corresponding to amino acids 333-351 of SEQ ID NO:2); unstructured loop 15 (corresponding to amino acids 352-362 of SEQ ID NO:2); alpha helix F (corresponding to amino acids 363-385 of SEQ ID NO:2); unstructured loop 16 (corresponding to amino acids 386-390 of SEQ ID NO:2); alpha helix G1 (corresponding to amino acids 391-395 of SEQ ID NO:2); unstructured loop 17 (corresponding to amino acids 396-404 of SEQ ID NO:2); alpha helix G2 (corresponding to amino acids 405-413 of SEQ ID NO:2); unstructured loop 18 (corresponding to amino acids 414-421 of SEQ ID NO:2); alpha helix H1 (corresponding to amino acids 422-428 of SEQ ID NO:2); unstructured loop 19 (corresponding to amino acids 429-431 of SEQ ID NO:2); alpha helix H2 (corresponding to amino acids 432-447 of SEQ ID NO:2); unstructured loop 20 (corresponding to amino acids 448-450 of SEQ ID NO:2); alpha helix H3 (corresponding to amino acids 451-455 of SEQ ID NO:2); unstructured loop 21 (corresponding to amino acids 456-461 of SEQ ID NO:2); alpha helix a-1 (corresponding to amino acids 462-470 of SEQ ID NO:2); unstructured loop 22 (corresponding to amino acids 471-473 of SEQ ID NO:2); alpha helix I (corresponding to amino acids 474-495 of SEQ ID NO:2); unstructured loop 23 (corresponding to amino acids 496-508 of SEQ ID NO:2); alpha helix J (corresponding to amino acids 509-521 of SEQ ID NO:2); J-K loop (corresponding to amino acids 522-534 of SEQ ID NO:2); alpha helix K (corresponding to amino acids 535-541 of SEQ ID NO:2); and unstructured loop 25 (corresponding to amino acids 542-548 of SEQ ID NO:2). The structural domains are depicted in FIGS. 2A-C.

Within the C-terminal catalytic domain is the conserved metal binding site that contains aspartate-rich regions 1 and 2. Aspartate-rich region 1, containing the conserved DDxxD motif, corresponds to amino acids D301, D302, T303, Y304 and D305 of SEQ ID NO:2. Asp301 and Asp305 bind the diphosphate moieties of FPP through coordination with $Mg^{2+}$. Aspartate-rich region 2, containing the NSE/DTE motif, corresponds to amino acids D445, D446, M447, Q448, G449, H450, E451, F452 and E453 of SEQ ID NO:2. This region binds an additional $Mg^{2+}$ ion through amino acids Asp445, Gly449 and Glu453.

As noted above, the active site substrate binding pocket of valencene synthase is hydrophobic and contains aromatic residues. Amino acid residues D301, D305, D445, G449 and E453 from the aspartate-rich regions and amino acid residues R264, W273, N294, I296, L297, S298, Y376, C402, C441, R442, L443, D446, Y522, D526 and Y528 of SEQ ID NO:2 form the substrate binding pocket of valencene synthase. These residues cradle the farnesyl side chain enforcing the substrate into a conformation that results in the production of valencene. Upon $(Mg^{2+})_3$-$PP_i$ binding, valencene synthase undergoes a structural change from an open to closed active site whereby the N-terminal region forms a cap, or lid, over the active site. The active site lid residues correspond to N-terminal domain amino acid residues R8, P9, T10, A11, D12, F13, H14 and P15 of SEQ ID NO:2 and C-terminal domain amino acid residues F452, E453, K455, R456, G457; A460, S461, A462, I463, D525, D526, G527 and Y528 of SEQ ID NO:2.

Additional residues that reside near the valencene synthase active site and are conserved within eremophilone-type sesquiterpenes include amino acid residues L270, Y376, S401, C402, A403, Y404, V407, C441, I518, I521 and T529 of SEQ ID NO:2 (see, Greenhagen et al., (2006) *Proc. Natl. Acad. Sci. USA* 103:9826-9831 and U.S. Pat. No. 7,442,785). These residues aid in the positioning of the reaction intermediates such that valencene is the dominantly formed product. Other products that can be produced by valencene synthase from FPP include, but are not limited to, germacrene A, beta-elemene (beta-elemene is formed by spontaneous decomposition of germacrene A), β-selinene, τ-selinene and 7-epi-α-selinene. Amino acid residues A517 and I518 of SEQ ID NO:2 were identified as playing a role in the late stage of the reaction after the C1-C10 cyclization, since mutation of them to A517I/I518V resulted in a β-elemene reaction product that may have derived from germacrene due to interruption of the normal reaction (see e.g. Eran Eyal (2001) *Computer Modelling of the Enzymatic Reaction Catalysed by 5-epi-aristolochene cyclase*. Doctoral Dissertation. Retrieved from Library Catalog Wiezmann Institute of Science. (System No. 000083214).

C. Modified Valencene Synthase Polypeptides and Encoding Nucleic Acid Molecules

Provided herein are modified valencene synthase polypeptides. Also provided herein are nucleic acid molecules that encode any of the modified valencene synthase polypeptides provided herein. The modified valencene synthase polypeptides provided herein catalyze the formation of valencene and/or other terpenes from any suitable acyclic pyrophosphate terpene precursor, including, but not limited to, FPP, GPP and GGPP. Typically, the modified valencene synthase polypeptides catalyze the formation of valencene from FPP. The modifications can be made in any region or domain of a valencene synthase provided the resulting modified valencene synthase polypeptide at least retains valencene synthase activity (i.e. the ability to catalyze the formation of valencene from an acyclic pyrophosphate terpene precursor, typically FPP).

The modifications can be a single amino acid modification, such as single amino acid replacements (substitutions), insertions or deletions, or multiple amino acid modifications, such as multiple amino acid replacements, insertions or deletions. In some examples, entire or partial domains or regions, such as any domain or region described herein below, are exchanged with corresponding domains or regions or portions thereof from another terpene synthase. Exemplary of modification are amino acid replacements, including single or multiple amino acid replacements. For example, modified valencene synthase polypeptides provided herein can contain at least or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 90, 95, 100, 105, 110, 115, 120 or more modified positions compared to the valencene synthase polypeptide not containing the modification.

The modifications described herein can be in any valencene synthase polypeptide. Typically, modifications are made in a citrus valencene synthase (CVS) derived from citrus. For example, the modifications described herein can be in a valencene synthase as set forth in any of SEQ ID NOS:2, 289-291, 346, 347, 752, 882 or 883 or any variant thereof, including any described in the art that have at least 60%, 70%, 80%, 90%, 91%, 92%, 93%, 94%, 95%, 96%, 97%, 98%, or 99% sequence identity to the valencene synthase polypeptide set forth in any of SEQ ID NOS:2, 289-291, 346, 347, 752, 882 or 883. Exemplary of a variant valence synthase is set forth in SEQ ID NO:886. In particular, provided herein are modified citrus-derived valencene synthase polypeptides that contain one or more modifications compared to a valencene synthase polypeptide set forth in any of SEQ ID NOS: 2, 289-291, 752 or 886. Also, it is understood that any of the variants set forth in SEQ ID NOS: 3-127, 350, 351, 723-731, 732-745, 746-751, 810-866, 887-890, 895, 944, 946, 948, 950, 952,954, 956, 958, 960, 962, 964, 966, 968, 970, 972, 974, 976, 978, 980, 982, 984, 986, 988, 990, 992, 994, 996 and 998 can be further modified, such as by inclusion of any of the modifications described herein.

In particular, the modified valencene synthase polypeptides provided herein contain amino acid replacements or substitutions, additions or deletions, truncations or combinations thereof with reference to the valencene synthase polypeptide set forth in SEQ ID NO:2. Generally, reference to positions and amino acids for modification, including amino acid replacement, herein are by CVS numbering with reference to the valencene synthase set forth in SEQ ID NO:2. It is within the level of one of skill in the art to make such modifications in valencene synthase polypeptides, such as any set forth in SEQ ID NOS: 2, 289-291, 346, 347, 752, 882 or 883 or any variant thereof. For example, FIGS. 1A-D and FIGS. 4A-D depict CVS numbering and corresponding positions between and among exemplary valencene synthase polypeptides. Based on this description, it is within the level of one of skill in the art to generate a valencene synthase containing any one or more of the described mutation, and test each for valencene synthase activity as described herein.

Also, in some examples, provided herein are modified active fragments of valencene synthase polypeptides that contain any of the modifications provided herein. Such fragments retain one or more properties of a wild-type valencene synthase. Typically, the modified active fragments exhibit valencene synthase activity (i.e. catalyze the formation of valencene from an acyclic pyrophosphate terpene precursor, such as FPP).

Modifications in a valencene synthase polypeptide also can be made to a valencene synthase polypeptide that also contains other modifications, including modifications of the primary sequence and modifications not in the primary sequence of the polypeptide. For example, modification described herein can be in a valencene synthase polypeptides that is a fusion polypeptide or chimeric polypeptide, including hybrids of different valencene synthase polypeptides or different terpene synthase polypeptides (e.g. contain one or more domains or regions from another terpene synthase) and also synthetic valencene synthase polypeptides prepared recombinantly or synthesized or constructed by other methods known in the art based upon the sequence of known polypeptides.

The valencene synthase polypeptides provided herein generally exhibit at least 62% amino acid sequence identity to the valencene synthase polypeptide set forth in SEQ ID NO:2. For example, the valencene synthase polypeptides provided herein generally exhibit at least or at least about 65%, 70%, 75%, 80%, 81%, 82%, 83%, 84%, 85%, 86%, 87%, 88%, 89%, 90%, 91%, 92%, 93%, 95%, 95%, 96%, 97%, 98% or 99% amino acid sequence identity to the valencene synthase polypeptide set forth in SEQ ID NO:2. In particular examples, the valencene synthase polypeptide also exhibits less than 95% sequence identity to the valencene synthase polypeptide set forth in SEQ ID NO:2. Thus, for example, valencene synthase polypeptides provided herein exhibit at least or more than 62% sequence identity to the valencene synthase polypeptide set forth in SEQ ID NO:2 and less than or less than about 94.7%, 94.6%, 94%, 93%, 92%, 91%, 90%, 89%, 88%, 87%, 86%, 84%, 83%, 82%, 81% 79%, 78%, 77%, 76%, 74%, 73%, 72% or 71% sequence identity with the wild-type valencene synthase polypeptide set forth in SEQ ID NO:2. Generally, the modified valencene synthase polypeptides provided herein exhibit between or about between 75% to 95%, between or about between 75% and 94%, between or about between 74% and 93%, between or about between 75% and 92%, between or about between 80% and 95%, between or about between 80% and 94%, between or about between 80% and 93%, between or about between 80% and 92%, between or about between 85% and 95%, between or about between 85% and 94%, between or about between 85% and 93% or between or about between 85% and 92%, each inclusive, sequence identity to the sequence of amino acids set forth in SEQ ID NO:2.

In some examples, the modified valencene synthase polypeptides have less than 100% or have 100% identity to the modified valencene synthase polypeptide set forth in SEQ ID NO:3. In other examples, the modified valencene synthase polypeptides have less than 100% or have 100% identity to the modified valencene synthase polypeptide set forth in SEQ ID NO:4. In additional examples, the modified valencene synthase polypeptides have less than 100% or have 100% identity to the modified valencene synthase polypeptide set forth in SEQ ID NO:5. For example, provided herein are modified valencene synthase polypeptides that have a sequence of amino acids that has at least 80% identity to the modified valencene synthase polypeptide set forth in SEQ ID NO:3 or SEQ ID NO:4, such as, for example, at least or at least about 81%, 82%, 83%, 84%, 85%, 86%, 87%, 88%, 89%, 90%, 91%, 92%, 93%, 94%, 95%, 96%, 97%, 98%, or 99% identity to the modified valencene synthase polypeptide set forth in SEQ ID NO:3 or SEQ ID NO:4.

Percent identity can be determined by one skilled in the art using standard alignment programs. For example, as can be determined by one of skill in the art using standard alignment programs, a modified valencene synthase polypeptide containing 37 amino acid replacements (such as K24Q/Q38N/K58Q/V60I/K88Q/Y93H/N97D/R98K/K125Q/K173Q/K184R/F209I/M212R/N214D/H219D/Y221V/E238D/K252Q/P281S/Q292K/L313C/S314T/L315M/T317S/Q321A/E333D/K336R/L337I/A345T/G357R/N369I/S377Y/T405R/N429G/A436S/T501P/D536E, e.g. the modified valencene synthase polypeptide named V75 set forth in SEQ ID NO:5 as described below) exhibits about 93.2% homology to the valencene synthase set forth in SEQ ID NO:2. In other examples, a modified valencene synthase polypeptide provided herein contains at least 80, 81, 82, 83 or 84 modifications, including replacements, insertions and/or deletions, so that the resulting polypeptide is less than or is or is about 85% identical to the wild-type valencene synthase polypeptide set forth in SEQ ID NO:2. In another example, a modified valencene polypeptide provided herein contains at least 107, 108, 109, 110, or 111 modifications (e.g. replacements, insertions and/or deletions) so that the resulting polypeptide is less than or is or is about 80% identical to the wild-type valencene synthase polypeptide set forth in SEQ ID NO:2.

The modifications can be in the N-terminal domain (corresponding to amino acids 1-266 of SEQ ID NO:2) and/or one or more modifications in the C-terminal catalytic domain (corresponding to amino acids 267-548 of SEQ ID NO:2). In some examples, the modifications are amino acid replacements. In further examples, the modified valencene synthase polypeptides provided herein contain one or more modifications in a structural domain such as the unstructured loop 1 (corresponding to amino acids 1-29 of SEQ ID NO:2); alpha helix 1 (corresponding to amino acids 30-39 and 44-52 of SEQ ID NO:2); unstructured loop 2 (corresponding to amino acids 53-58 of SEQ ID NO:2); alpha helix 2 (corresponding to amino acids 59-71 of SEQ ID NO:2); unstructured loop 3 (corresponding to amino acids 72-78 of SEQ ID NO:2); alpha helix 3 (corresponding to amino acids 79-93 of SEQ ID NO:2); unstructured loop 4 (corresponding to amino acids 94-100 of SEQ ID NO:2); alpha helix 4 (corresponding to amino acids 101-114 of SEQ ID NO:2); unstructured loop 5 (corresponding to amino acids 115-141 of SEQ ID NO:2); alpha helix 5 (corresponding to amino acids 142-152 of SEQ ID NO:2); unstructured loop 6 (corresponding to amino acids 153-162 of SEQ ID NO:2); alpha helix 6 (corresponding to amino acids 163-173 of SEQ ID NO:2); unstructured loop 7 (corresponding to amino acids 174-184 of SEQ ID NO:2); alpha helix 7 (corresponding to amino acids 185-194 of SEQ ID NO:2); unstructured loop 8 (corresponding to amino acids 195-201 of SEQ ID NO:2); alpha helix 8 (corresponding to amino acids 202-212 of SEQ ID NO:2); unstructured loop 9 (corresponding to amino acids 213-222 of SEQ ID NO:2); alpha helix A (corresponding to amino acids 223-253 of SEQ ID NO:2); A-C loop (corresponding to amino acids 254-266 of SEQ ID NO:2); alpha helix C (corresponding to amino acids 267-276 of SEQ ID NO:2); unstructured loop 11 (corresponding to amino acids 277-283 of SEQ ID NO:2); alpha helix D (corresponding to amino acids 284-305 of SEQ ID NO:2); unstructured loop 12 (corresponding to amino acids 306-309 of SEQ ID NO:2); alpha helix D1 (corresponding to amino acids 310-322 of SEQ ID NO:2); unstructured loop 13 (corresponding to amino acids 323-328 of SEQ ID NO:2); alpha helix D2 (corresponding to amino acids 329 of SEQ ID NO:2); unstructured loop 14 (corresponding to amino acids 330-332 of SEQ ID NO:2); alpha helix E (corresponding to amino acids 333-351 of SEQ ID NO:2); unstructured loop 15 (corresponding to amino acids 352-362 of SEQ ID NO:2); alpha helix F (corresponding to amino acids 363-385 of SEQ ID NO:2); unstructured loop 16 (corresponding to amino acids 386-390 of SEQ ID NO:2); alpha helix G1 (corresponding to amino acids 391-395 of SEQ ID NO:2); unstructured loop 17 (corresponding to amino acids 396-404 of SEQ ID NO:2); alpha helix G2 (corresponding to amino acids 405-413 of SEQ ID NO:2); unstructured loop 18 (corresponding to amino acids 414-421 of SEQ ID NO:2); alpha helix H1 (corresponding to amino acids 422-428 of SEQ ID NO:2); unstructured loop 19 (corresponding to amino acids 429-431 of SEQ ID NO:2); alpha helix H2 (corresponding to amino acids 432-447 of SEQ ID NO:2); unstructured loop 20 (corresponding to amino acids 448-450 of SEQ ID NO:2); alpha helix H3 (corresponding to amino acids 451-455 of SEQ ID NO:2); unstructured loop 21 (corresponding to amino acids 456-461 of SEQ ID NO:2); alpha helix a-1 (corresponding to amino acids 462-470 of SEQ ID NO:2); unstructured loop 22 (corresponding to amino acids 471-473 of SEQ ID NO:2); alpha helix I (corresponding to amino acids 474-495 of SEQ ID NO:2); unstructured loop 23 (corresponding to amino acids 496-508 of SEQ ID NO:2); alpha helix J (corresponding to amino acids 509-521 of SEQ ID NO:2); J-K loop (corresponding to amino acids 522-534 of SEQ ID NO:2); alpha helix K (corresponding to amino acids 535-541 of SEQ ID NO:2); and/or unstructured loop 25 (corresponding to amino acids 542-548 of SEQ ID NO:2). As described elsewhere herein, the modifications in a domain or structural domain can be by replacement of corresponding heterologous residues from another terpene synthase.

To retain valencene synthase activity, modifications typically are not made at those positions that are less tolerant to change. Such positions can be within domains or regions that are required for catalysis of valencene from FPP and/or substrate binding. In some instances, the positions are in regions that are highly conserved, such as the metal-binding aspartate-rich motifs (DDxxD). For example, as demonstrated in Example 3.C, positions corresponding to positions 301, 302, 303, 305 and 306 of SEQ ID NO:2, which are part of or adjacent to the first metal-binding aspartate-rich motif, and positions corresponding to positions 445, 446, and 449, which are part of a second aspartate-rich region, are generally less tolerant to modification and typically result in a polypeptide with decreased valencene synthase activity. Similarly, positions corresponding to 267, 269, 270, 271, 273, 295, 298, 441 and 442 of SEQ ID NO:2, which likely are involved in forming the substrate binding pocket, also are generally less tolerant to modification and typically result in a polypeptide with decreased valencene synthase activity. Other positions that are shown in Example 3.0 to be less tolerant to change include, but are not limited to, positions corresponding to positions 8, 9, 178, 203, 277, 287, 312, 394, 398, 401, 402, 403, 404, 407, 408, 454 and 457 of SEQ ID NO:2.

Hence, provided herein are modified valencene synthase polypeptides, in particular modified valencene synthase polypeptides that exhibit increased valencene yield, that do not contain modification(s) (e.g. amino acid replacement or substitution) at any of amino acid residues 8, 9, 178, 203, 267, 269, 270, 271, 273, 277, 287, 295, 298, 301, 302, 303, 305, 306, 312, 394, 398, 401, 402, 403, 404, 407, 408, 441, 442, 445, 446, 449, 454 and 457 of SEQ ID NO:2. In some examples, other positions that are likely less tolerant to change can include, for example, positions 20, 264, 266, 376, 436, 448, 512, 515, 516, 519, 520, 527, 528 and 529 (U.S. Pat. Pub. No. US20100216186). In some examples, a modified valencene synthase provided herein with increased valencene yield typically does not contain modifications at any of positions corresponding to positions 20, 178, 203, 264, 266, 267, 269, 270, 271, 273, 277, 287, 295, 298, 301, 302, 303, 305, 306, 312, 376, 394, 398, 401, 402, 403, 404, 407, 408, 436, 441, 442, 445, 446, 448, 449, 454, 457, 512, 515, 516, 519, 520, 527, 528 and 529 of SEQ ID NO:2. It is understood that this is a guide only, and while modifications at these positions generally result in a valencene synthase with reduced activity compared to wild-type valencene synthase, such modifications can be included in any of the modified valencene synthases provided herein. For example, one of skill in the art understands conservative amino acid substitutions, such as those provided in Table 2, can be used to reduce the likelihood of a modification resulting in a reduction in activity, such as a reduction in the amount of valencene produced from FPP compared to wild-type valencene synthase. Also, in some examples, modification can be made at any one of these positions when the modification is due to a domain swap with amino acid set forth in a corresponding domain of another synthase polypeptide.

Hence, exemplary positions that can be modified, for example by amino acid replacement or substitution, include, but are not limited to, positions corresponding to positions 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 50, 53, 54, 55, 56, 57, 58, 60, 62, 69, 77, 78, 82, 84, 85, 86, 87, 88, 89, 90, 91, 92, 93, 94, 95, 96, 97, 98, 99, 100, 101, 102, 103, 104, 105, 106, 107, 111, 113, 114, 116, 117, 118, 120, 121, 122, 124, 125, 127, 129, 130, 132, 135, 136, 138, 139, 141, 142, 144, 146, 151, 152, 153, 154, 155, 156, 157, 158, 159, 160, 162, 163, 165, 166, 168, 169, 170, 171, 172, 173, 174, 175, 176, 177, 178, 179, 180, 181, 182, 183, 184, 186, 187, 188, 189, 190, 191, 193, 194, 195, 196, 197, 198, 200, 201, 202, 203, 204, 205, 206, 207, 208, 209, 210, 211, 212, 213, 214, 215, 216, 217, 218, 219, 220, 221, 222, 223, 224, 227, 228, 229, 238, 252, 257, 263, 267, 268, 269, 270, 271, 272, 273, 274, 275, 276, 277, 278, 279, 280, 281, 282, 283, 284, 287, 288, 289, 290, 291, 292, 293, 294, 295, 296, 297, 298, 299, 300, 301, 302, 303, 305, 306, 307, 310, 311, 312, 313, 314, 315, 316, 317, 318, 319, 320, 321, 322, 323, 324, 325, 326, 329, 331, 332, 333, 334, 335, 336, 337, 338, 339, 340, 341, 342, 343, 344, 345, 346, 347, 348, 349, 350, 351, 352, 353, 354, 355, 356, 357, 358, 359, 360, 361, 362, 363, 364, 365, 366, 367, 368, 369, 370, 371, 372, 373, 375, 377, 378, 380, 381, 382, 386, 387, 388, 389, 390, 391, 392, 393, 394, 395, 397, 398, 399, 400, 401, 402, 403, 404, 405, 406, 407, 408, 409, 410, 411, 412, 413, 414, 415, 422, 423, 424, 428, 429, 434, 435, 436, 438, 439, 440, 441, 442, 443, 444, 445, 446, 447, 448, 449, 451, 452, 454, 457, 465, 468, 473, 474, 484, 492, 495, 496, 499, 500, 501, 506, 522, 523, 524, 525, 526, 527, 528, 529, 530, 531, 532, 533, 534, 536 and/or 539 by CVS numbering with reference to amino acid positions set forth in SEQ ID NO:2.

These positions for modification are exemplary only. It is understood that many other positions in the valencene synthase polypeptide can be modified without adversely affecting the ability of the polypeptide to produce valencene from FPP. For example, other positions in the unstructured loops (including any of unstructured loops 1 through 25) could be modified without adversely affecting valencene production.

The modification can be an amino acid replacement, insertion or deletion. Typically, the modification is an amino acid replacement, which can be a conservative substitution, such as set forth in Table 2, or a non-conservative substitution. One of skill in the art understands that, in general, conservative amino acid substitutions reduce the likelihood of the modification adversely affecting activity, such as a reduction in the amount of valencene produced from FPP compared to wild-type valencene synthase. Conversely, non-conservative substitutions are generally more likely to affect activity, thereby resulting in an increase or decrease in the amount of valencene produced from FPP compared to wild-type valencene synthase. Modifications that result in increased production of valencene from FPP can be identified using the assays described herein and well known in the art, thus allowing for identification of modified valencene synthase polypeptides with improved ability to produce valencene from FPP.

Exemplary amino acid substitutions (or replacements) that can be included in the modified valencene synthase polypeptides provided include, but are not limited to, amino acid replacement corresponding to M1T, S2R, S2K, S2E, S2Q, S2P, S2T, S2L, S2H, S2A, S2V, S2N, S2C, S2G, S3D, S3R, S3G, S3I, S3E, S3V, S3A, S3T, S3L, S3M, S3P, S3N, G4K, G4V, G4N, G4I, G4R, G4S, G4P, G4A, G4E, G4F, G4C, G4T, G4L, G4Q, E5A, E5G, E5S, E5T, E5D, E5H, E5I, E5P, E5L, E5N, E5V, E5R, T6R, T6V, T6D, T6L, T6A, T6E, T6K, T6S, T6G, T6C, T6M, T6Y, T6I, F7C, F7A, F7Q, F7K, F7S, F7G, F7T, F7L, F7R, F7P, F7N, F7D, F7E, F7V, T10V, A11T, D12N, S16N, L17I, R19K, R19P, R19G, N20D, H21Q, L23I, L23S, K24A, K24Q, K24Y, K24T, G25Y, A26T, S27P, D28G, D28E, F29D, D33T, H34R, T35A, A36C, T37K, Q38V, Q38A, Q38N, Q38E, R40Q, H41I, R50G, T53L, T53R, D54A, D54P, D54C, A55T, A55P, A55R, A55V, A55Q, E56G, E56P, E56F, E56A, E56T, E56Q, D57R, D57P, D57S, D57Q, D57A, K58Q, K58R, K58P, K58E, K58A, V60I, V60G, K62R, V69I, F78L, I82V, A85M, I86L, Q87D, K88Q, K88A, K88H, L89I, C90Y, P91N, I92Y, I92N, I92S, Y93H, Y93F, Y93F, I94E, I94H, D95A, S96H, S96C, N97D, N97E, R98K, R98Y, R98D, A99N, A99M, H102Y, L106A, L106S, L106K, L106F, L111S, Q113R, I116Y, K117T, V122I, E124N, K125A, K125Q, K127T, D129E, E130R, R132G, S135E, S136A, N139S, Q142R, S146G, Y152H, M153N, M153G, H159Q, H159K, H159R, E163D, K173E, K173Q, K173A, Q178A, D179P, V181L, T182K, P183S, K184R, K184P, Q188R, I189A, I189V, I189P, T200Q, P202S, F209I, F209H, F209E, F209L, F209T, M210T, M212R, M212D, M212N, M212S, M212A, M212Y, M212K, M212F, M212H, M212Q, M212I, M212S, M212V, I213Y, I213M, I213A, I213R, I213S, I213L, I213F, I213S, I213P, I213Q, I213N, I213K, I213V, I213Y, N214D, N214E, N214S, N214L, N214Y, N214V, N214P, N214H, N214C, N214A, N214T, N214R, N214Y, N214Q, S215H, S215G, S215K, S215R, S215P, S215A, S215N, S215T, S215L, S215V, S215Q, S215D, T216Q, T216Y, T216E, T216P, T216R, T216C, T216V, T216K, T216D, T216A, T216S, T216K, S217R, S217K, S217F, S217I, S217T, S217G, S217Y, S217N, S217H, S217E, S217F, S217C, S217E, S217D, D218I, D218G, D218V, D218C, D218P, D218M, D218R, D218L, D218S, D218A, D218Y, D218K, D218E, H219D, H219A, H219L, H219C, H219W, H219R, H219S, H219F, H219E, H219G, H219Q, H219A, L220V, L220S, L220T, L220P, L220M, L220A, L220H, L220E, L220G, L220D, L220F, Y221C, Y221V, Y221Q, Y221F, Y221S, Y221N, Y221T, Y221P, Y221L, Y221K, Y221W, Y221E, Y221V, Y221H, N227S, E238D, K252A, K252Q, T257A, D274M, D274N, D274S, D274F, D274G, D274H, D274E, F279S, F279I, F279P, F279D, F279L, F279N, F279M, F279H, F279C, F279A, F279G, F279W, E280L, P281S, P281H, P281K, P281A, P281W, P281L, P281Y, Q282L, Q282S, Q282A, Q282I, Q282R, Q282Y, Q282G, Q282W, Q282P, Q282E, Y283F, Y283N, A284T, A284G, A284P, A284V, A284R, A284D, A284E, A284S, A284H, A284K, A284I, A284W, A284M, Q292K, I299Y, Y307H, L310H, E311P, E311T, L313C, S314A, S314T, L315M, F316L, T317S, E318K, A319T, V320D, V320G, V320S, Q321A, W323R, N324S, I325T, E326K, E333D, K336R, L337I, L343V, A345V, A345T, N347L, N347S, E348A, E348S, E350K, G357R, H360L, H360A, C361R, V362A, E367G, N369I, Q370D, Q370H, Q370G, K371G, A375D, S377Y, Y387C, I397V, L399S, T405R, T409G, N410S, F424L, N429S, N429G, A436S, V439L, Q448L, C465S, K468Q, S473Y, K474T, E484D, I492V, E495G, K499E, P500L, T501P, P506S, D536E, or A539V by CVS numbering with reference to positions set forth in SEQ ID NO:2.

The modified valencene synthase polypeptides can contain any one or more of the recited amino acid substitutions, in any combination, with or without additional modifications. Generally, multiple modifications provided herein can be combined by one of skill in the art so long as the modified polypeptide retains the ability to catalyze the formation of valencene and/or other terpenes from any suitable acyclic pyrophosphate terpene precursor, including, but not limited to, FPP, GPP and GGPP. Typically, the resulting modified valencene synthase polypeptide exhibits similar or increased valencene production from FPP compared to wild-type valencene synthase. In some instances, the resulting modified valencene synthase polypeptide exhibits decreased valencene production from FPP compared to wild-type valencene synthase.

Also provided herein are nucleic acid molecules that encode any of the modified valencene synthase polypeptides provided herein. In particular examples, the nucleic acid sequence can be codon optimized, for example, to increase expression levels of the encoded sequence. The particular codon usage is dependent on the host organism in which the modified polypeptide is expressed. One of skill in the art is familiar with optimal codons for expression in bacteria or yeast, including for example *E. coli* or *Saccharomyces cerevisiae*. For example, codon usage information is available from the Codon Usage Database available at kazusa.or.jp.codon (see Richmond (2000) *Genome Biology,* 1:241 for a description of the database). See also, Forsburg (1994) *Yeast,* 10:1045-1047; Brown et al. (1991) *Nucleic Acids Research,* 19:4298; Sharp et al. (1988) *Nucleic Acids Res.,* 16:8207-8211; Sharp et al. (1991) *Yeast,* 657-78. In examples herein, nucleic acid sequences provided herein are codon optimized based on codon usage in *Saccharomyces cerevisiae.*

The modified polypeptides and encoding nucleic acid molecules provided herein can be produced by standard recombinant DNA techniques known to one of skill in the art. Any method known in the art to effect mutation of any one or more amino acids in a target protein can be employed. Methods include standard site-directed or random mutagenesis of encoding nucleic acid molecules, or solid phase polypeptide synthesis methods. For example, as described herein, nucleic acid molecules encoding a valencene synthase polypeptide can be subjected to mutagenesis, such as random mutagenesis of the encoding nucleic acid, by error-prone PCR, site-directed mutagenesis, overlap PCR, gene shuffling, or other recombinant methods. The nucleic acid encoding the polypeptides can then be introduced into a host cell to be expressed heterologously. Hence, also provided herein are nucleic acid molecules encoding any of the modified polypeptides provided herein. In some examples, the modified valencene synthase polypeptides are produced synthetically, such as using solid phase or solutions phase peptide synthesis.

The encoded modified valencene synthase polypeptides provided herein exhibit valencene synthase activity. The encoded modified valencene synthase polypeptides can produce about the same amount or increased amount or more valencene from FPP compared to wild-type valencene synthase polypeptide set forth in SEQ ID NO:2 when tested in an appropriate assay (under the same conditions), such as any described below. For example, modified valencene polypeptides provided herein generally produce at least 40% of the amount of valencene from FPP compared to the amount of valencene produced from FPP by the wild-type valencene synthase produced in SEQ ID NO:2, such as at least 45%, 50%, 55%, 60%, 65%, 70%, 75%, 80%, 85%, 90%, 95%, 100%, 105%, 110%, 115%, or 120% of the amount.

Typically, the modified polypeptides provided herein exhibit increased production of valencene from FPP compared to the production by wild-type valencene synthase set forth in SEQ ID NO:2. For example, the modified valencene synthase polypeptides provided herein produce more or greater or increased valencene from FPP compared to wild-type valencene synthase polypeptide set forth in SEQ ID NO:2 when tested in an appropriate assay (under the same conditions). In some examples, the modified valencene synthase polypeptides provided herein can produce more than the amount, such as 110% to 5000%, for example, 150% to 2000%, such as 150% to 1000%, 500% to 2000%, or 200% to 500% of the amount of valencene from FPP compared to the amount of valencene produced from FPP by the wild-type valencene synthase produced in SEQ ID NO:2. For example, modified valencene polypeptides provided herein produce valencene from FPP in an amount that is increased at least or at least about 10%, 20%, 30%, 40%, 50%, 60%, 70%, 80%, 90%, 100%, 110%, 120%, 130%, 140%, 150%, 160%, 170%, 180%, 190%, 200%, 250%, 300%, 350%, 400%, 500% or more than the amount of valencene produced from FPP by the valencene synthase set forth in SEQ ID NO:2. It is understood that a 10% increase in valencene production or greater valencene production, for example, means that the level of valencene produced by a modified polypeptide is 110% or about 110% of the level of valencene produced by the wildtype valencene synthase set forth in SEQ ID NO:2. As a fold-increase in valencene produced, the modified valencene polypeptides provided herein produce at least 1.1-fold the amount of valencene produced from FPP by the valencene synthase set forth in SEQ ID NO:2, generally at least 1.5-fold or at least 2-fold. For example, the modified valencene polypeptides provided herein produce at least or about at least or 1.1-fold, 1.2-fold, 1.3-fold, 1.4-fold, 1.5-fold, 1.6-fold. 1.7-fold, 1.8-fold, 1.9-fold, 2-fold, 2.5-fold, 3-fold, 4-fold, 5-fold, 6-fold, 7-fold, 8-fold, 9-fold, 10-fold, 15-fold, 20-fold, 25-fold, 30-fold, 40-fold, 50-fold, 60-fold, 70-fold, 80-fold, 90-fold, 100-fold or more the amount of valencene produced from FPP by the valencene synthase set forth in SEQ ID NO:2.

Based on the description herein, it is within the level of one of skill in the art to identify a modified valencene synthase that produces more valencene than is produced from wildtype valencene synthase. For example, as described herein, modified valencene synthase polypeptides can be selected for that result in increased production of valencene from FPP compared to the production by wild-type valencene synthase. This is exemplified in the Examples herein. For example, Example 3 describes the generation of mutant valencene synthase nucleic acid molecules encoding modified valencene synthase polypeptides and selection of transformants that produced elevated levels of valencene compared to those containing the wild-type gene. The DNA from selected transformants was sequenced to determine the amino acid change(s) in the encoded variant valencene synthase that conferred the increased property. It is within the level of one of skill in the art to generate and screen for mutants to select for those with altered properties as described herein. Section F describes assays to assess various properties and activities including, for example, production of valencene or nootkatone.

In some examples, the modified valencene synthase polypeptides provided herein exhibit altered substrate specificity and/or product selectivity, and/or altered product distribution (i.e. altered relative amounts and/or types of terpenes) compared to wild-type valencene synthase. In other examples, the modified valencene synthase polypeptides provided herein exhibit altered substrate specificity and/or product selectivity and/or altered product distribution (i.e. altered relative amounts and/or types of terpenes) compared to variant valencene synthase polypeptides set forth in SEQ ID NO:3 (V18) or SEQ ID NO:4 (V19). The product distribution of terpenes produced by wild-type valencene synthase includes valencene, as well as a number of other terpene products (e.g terpene byproduct or products derived therefrom) including, for example, β-selinene, τ-selinene, eremophilone, 7-epi-α-selinene, germacrene A and β-elemene. As described in Example 8 herein, the proportion of terpene product distribution as a percentage of total terpenes produced by wildtype valencene synthase is similar to variant valencene synthase polypeptides set forth in SEQ ID NO:3 or SEQ ID NO:4.

Modified valencene synthase polypeptides provided herein include those that exhibit an altered product distribution such that a greater percentage of valencene is produced as a total percentage of terpene product, and a decreased percentage of another terpene product or products (e.g. terpene byproduct or byproducts or products derived therefrom) is produced. For example, provided herein are modified valencene synthase polypeptides that produce a greater percentage of valencene as a percentage of the total amount of terpenes produced than is produced by wild-type valencene synthase set forth in SEQ ID NO:2. The amount of valencene produced as a percentage of total terpenes is increased 0.01% to 90%, for example, 1% to 10%, such as greater than or about 0.5%, 1%, 2%, 3%, 4%, 5%, 6%, 7%, 8%, 9%, 10%, 20%, 30%, 40%, 50%, 60%, 70%, 80% or 90%. In some examples, the modified valencene synthase polypeptides provided herein produce less terpene products other than valencene as a percentage of total terpenes than does wild-type valencene synthase set forth in SEQ ID NO:2 or the variant valencene synthase polypeptides set forth in SEQ ID NO:3 or 4. The percentage of product other than valencene can be decreased by greater than or about or 0.01% to 90%, 1% to 80%, 5% to 80%, 10% to 60% or 0.01% to 20%, such as greater than or about 0.5%, 1%, 2%, 3%, 4%, 5%, 6%, 7%, 8%, 9%, 10%, 20%, 30%, 40%, 50%, 60%, 70%, 80%, 90% or more. For example, modified valencene synthase polypeptides provided herein produce decreased percentage of β-elemene as a percentage of total terpenes produced than does a valencene synthase polypeptide set forth in SEQ ID NO:2, 3 or 4. The percentage of β-elemene as a percentage of total terpenes produced can be decreased by greater than or about or 0.01% to 50%, (i.e. reduction in the amount of β-elemene of 0.01% to 50%), 0.01% to 20%, for example, 1% to 10%, such as decreased by greater than or about 0.5%, 1%, 2%, 3%, 4%, 5%, 6%, 7%, 8%, 9%, 10%, 20%, 30%, 40% or 50%. Based on the description herein and in Example 8, it is within the level of one of skill in the art to identify such modified valencene synthases. Exemplary of such modified valencene synthase polypeptides that exhibit altered product distribution, such as decreased formation of β-elemene, are set forth in Section C.3 below.

The modified valencene polypeptides provided herein also can exhibit other activities and/or properties. The modified valencene synthase polypeptides can exhibit, for example, increased catalytic activity, increased substrate (e.g. FPP) binding, increased stability and/or increased expression in a host cell. Such altered activities and properties can result in increased valencene production from FPP. In other examples, the modified valencene synthase polypeptides can catalyze the formation of terpenes other than valencene from any suitable substrate, such as, for example, FPP, GPP, GGPP. For example, the modified valencene synthases can produce one or more monoterpenes or diterpenes, or one or more sesquiterpenes other than valencene. Typically, the modified valencene synthase polypeptides produce more valencene than any other terpene.

In the subsections below, exemplary modified valencene synthase polypeptides and encoding nucleic acid molecules provided herein are described.

1. Modified Valencene Synthase Polypeptides—Exemplary Amino Acid Replacements

Provided herein are modified valencene synthase polypeptides that contain one or more amino acid replacements in a valencene synthase polypeptide and that exhibit valencene synthase activity. The modified valencene synthase polypeptides can exhibit 50% to 5000%, such as 50% to 120%, 100% to 500% or 110% to 250% of the valencene production from FPP compared to the valencene synthase polypeptide not containing the amino acid replacement and/or compared to wild-type valencene synthase polypeptide set forth in SEQ ID NO:2.

Typically, the modified valencene synthase polypeptides provided herein exhibit increased valencene production from FPP compared to the valencene synthase polypeptide not containing the amino acid replacement, such as compared to wild-type valencene synthase set forth in SEQ ID NO:2. For example, the modified valencene synthase polypeptides can produce valencene from FPP in an amount that is at least or about at least 101%, 102%, 103%, 104%, 105%, 106%, 107%, 108%, 109%, 110%, 115%, 120%, 125%, 130%, 135%, 140%, 145%, 150%, 160%, 170%, 180%, 200%, 250%, 300%, 350%, 400%, 500%, 1500%, 2000%, 3000%, 4000%, 5000% of the amount of valencene produced from FPP by wild-type valencene synthase set forth in SEQ ID NO:2 under the same conditions. For example, the valencene production is increased at least or about at least 1.2-fold, 1.5-fold, 2-fold, 3-fold, 4-fold, 5-fold, 6-fold, 7-fold, 8-fold, 9-fold, 10-fold, 11-fold, 12-fold, 13-fold, 14-fold, 15-fold, 16-fold, 17-fold, 18-fold, 19-fold, 20-fold, 25-fold, 30-fold, 40-fold, 50-fold, 60-fold, 70-fold, 80-fold, 90-fold, 100-fold, 200-fold, 300-fold, 400-fold or more.

In particular examples, the modified valencene synthase polypeptides contain an amino acid replacement at one or more amino acid positions identified as being associated with increased valencene production. Such positions can be identified using mutagenesis and selection or screening methods to identify those positions that result in increased valencene production. For example, as described herein in Example 3, valencene synthase mutants and encoding nucleic acids were generated by error prone PCR and were screened to identify those that resulted in elevated levels of valencene compared to valencene produced by valencene synthase set forth in SEQ ID NO:2. Variants V18 and V19, generated as containing combination of such mutations, exhibit at least 10-fold greater production of valencene compared to wildtype (see Example 3B). Further exemplary mutants are described in the Examples that exhibit increased valencene production as compared to V18 and V19 and/or the wild-type valencene synthase polypeptide set forth in SEQ ID NO:2.

The modified valencene synthase polypeptides can contain at least or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 53, 53, 54, 55, 56, 57, 58, 59, 60, 61, 62, 63, 64, 65, 66, 67, 68, 59, 70, 71, 72, 73, 74, 75, 76, 77, 78, 79, 80, 82, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, or more amino acid replacements. Additional modifications, such as insertions or deletions, also can be included. The modified polypeptides generally contain at least 29 amino acid replacements. The amino acid replacement can be in a valencene synthase as set forth in any of SEQ ID NOS:2, 289-291, 346, 347, 752, 882 or 883 or any variant thereof. For example, the replacements can be in any citrus valencene synthase polypeptide, for example, any set forth in any of SEQ ID NOS: 2, 289-291, 752 or 886, or a variant thereof. As described above, in examples herein, the modified valencene synthase polypeptides exhibit less than 95% sequence identity to the valencene synthase set forth in SEQ ID NO:2, such as between or about between 62% to 94.9% sequence identity, and can contain at least 75% sequence identity and less than 80%, 81%, 82%, 83%, 85%, 85%, 86%, 87%, 88%, 89%, 90%, 91%, 92%, 93% or 94% sequence identity to the valencene synthase polypeptide set forth in SEQ ID NO:2. For example, modified valencene synthase polypeptides provided herein exhibit at least or about or 82% and less than 95% sequence identity to the valencene synthase set forth in SEQ ID NO:2.

For example, the modified valencene synthase polypeptides provided herein contain an amino acid replacement (substitution) at one or more amino acid positions corresponding to positions 1, 2, 3, 4, 5, 6, 7, 11, 19, 20, 23, 24, 28, 38, 50, 53, 54, 55, 56, 57, 58, 60, 62, 69, 78, 82, 88, 93, 97, 98, 102, 106, 111, 113, 125, 132, 152, 153, 159, 163, 173, 184, 188, 189, 200, 202, 209, 210, 212, 213, 214, 215, 216, 217, 218, 219, 220, 221, 227, 238, 252, 257, 274, 279, 280, 281, 282, 283, 284, 292, 297, 299, 307, 310, 311, 313, 314, 315, 316, 317, 318, 319, 320, 321, 323, 324, 325, 326, 333, 336, 337, 343, 345, 347, 348, 350, 357, 360, 361, 362, 367, 369, 370, 371, 375, 377, 387, 397, 399, 405, 409, 410, 424, 429, 436, 439, 448, 465, 468, 473, 474, 484, 492, 495, 499, 500, 501, 506, 536 or 539 of the valencene synthase set forth in SEQ ID NO:2.

For example, the modified valencene polypeptides provided herein contain an amino acid replacement (substitution) at one or more amino acid positions corresponding to positions M1, S2, S3, G4, E5, T6, F7, A11, R19, N20, L23, K24, D28, Q38, R50, T53, D54, A55, E56, D57, K58, V60, K62, V69, F78, I82, K88, Y93, N97, R98, H102, L106, L111, Q113, K125, R132, Y152, M153, H159, E163, K173, K184, Q188, I189, T200, P202, F209, M210, M212, I213, N214, S215, T216, S217, D218, H219, L220, Y221, N227, E238, K252, T257, D274, F279, E280, P281, Q282, Y283, A284, Q292, N297, I299, Y307, L310, E311, L313, S314, L315, F316, T317, E318, A319, V320, Q321, W323, N324, I325, E326, E333, K336, L337, L343, A345, N347, E348, E350, G357, H360, C361, V362, E367, N369, Q370, K371, A375, S377, Y387, I397, L399, T405, T409, N410, F424, N429, V439, A436, Q448, C465, K468, S473, K474, E484, I492, E495, K499, P500, T501, P506, D536 or A539 by CVS numbering with reference to the valencene synthase set forth in SEQ ID NO:2. It is understood that any amino acid replacements described herein can be made to the native or endogenous residue in the corresponding position in other valencene synthase polypeptides, including for example, a valencene synthase polypeptide set forth in any of SEQ ID NOS: 2, 289-291, 752 or 886, or a variant thereof. The corresponding position and amino acid replacement can be determined by alignment with SEQ ID NO:2 as depicted in FIGS. 1A-D. Any amino acid residue can be used to replace the native or endogenous residue at the position. Typically, the amino acid residue is one that does not reduce or eliminate enzymatic activity. In some instances, the amino acid substitution is a conservative substitution, such as a substitution set forth in Table 2. In other instances, the amino acid substitution is not a conservative substitution. For example, the amino acid can be replaced by a arginine (R), lysine (K), glutamine (Q), glutamic acid (E), proline (P), threonine (T), leucine (L), histidine (H), aspartic acid (D), glycine (G), isoleucine (I), valine (V), alanine (A), asparagine (N), serine (S), cysteine (C), phenylalanine (F), methionine (M), tyrosine (Y), or tryptophan (W).

Exemplary amino acid substitutions (or replacements) that can be included in the modified valencene synthase polypeptides provided include, but are not limited to, M1T, S2R, S2K, S2E, S2Q, S2P, S2T, S2L, S2H, S2A, S2V, S3D, S3R, S3G, S3I, S3E, S3V, S3A, S3T, S3L, S3M, S3N, G4K, G4V, G4N, G4I, G4R, G4S, G4P, G4A, G4E, G4F, G4C, G4T, G4L, E5A, E5G, E5S, E5T, E5D, E5H, E5I, E5P, E5L, E5N, T6R, T6V, T6D, T6L, T6A, T6E, T6K, T6S, T6G, T6C, T6M, T6Y, F7C, F7A, F7Q, F7K, F7S, F7G, F7T, F7L, F7R, F7P, A11T, R19K, R19P, N20D, L23S, K24A, K24Q, K24Y, D28G, Q38V, Q38A, Q38N, R50G, T53L, T53R, D54A, D54P, D54C, A55T, A55P, A55R, A55V, A55Q, E56G, E56P, E56F, E56A, E56T, E56Q, D57R, D57P, D57S, D57Q, D57A, K58Q, K58R, K58P, K58E, K58A, V60I, V60G, K62R, V69I, F78L, I82V, K88Q, K88A, Y93H, N97D, R98K, H102Y, L106A, L106S, L106K, L106F, L111S, Q113R, K125A, K125Q, R132G, Y152H, M153N, M153G, H159Q, H159K, H159R, E163D, K173E, K173Q, K173A, K184R, Q188R, I189A, I189V, I189P, T200Q, P202S, F209I, F209H, F209E, F209L, F209T, M210T, M212R, M212D, M212N, M212S, M212A, M212Y, M212K, M212F, M212H, M212Q, I213Y, I213M, I213A, I213R, I213S, I213L, I213F, I213S, I213P, I213Q, I213N, I213K, I213V, N214D, N214E, N214S, N214L, N214Y, N214V, N214P, N214H, N214C, N214A, N214T, N214R, S215H, S215G, S215K, S215R, S215P, S215A, S215N, S215T, S215L, S215V, S215Q, T216Q, T216Y, T216E, T216P, T216R, T216C, T216V, T216K, T216D, T216A, T216S, S217R, S217K, S217F, S217I, S217T, S217G, S217Y, S217N, S217H, S217E, S217F, S217C, D218I, D218G, D218V, D218C, D218P, D218M, D218R, D218L, D218S, D218A, D218Y, D218K, H219D, H219A, H219L, H219C, H219W, H219R, H219S, H219F, H219E, L220V, L220S, L220T, L220P, L220M, L220A, L220H, L220E, L220G, L220D, Y221C, Y221V, Y221Q, Y221F, Y221S, Y221N, Y221T, Y221P, Y221L, Y221K, Y221W, Y221E, Y221V, N227S, E238D, K252A, K252Q, T257A, D274M, D274N, D274S, D274F, D274G, D274H, D274E, F279S, F279I, F279P, F279D, F279L, F279N, F279M, F279H, F279C, F279A, F279G, F279W, E280L, P281S, P281H, P281K, P281A, P281W, P281L, P281Y, Q282L, Q282S, Q282A, Q282I, Q282R, Q282Y, Q282G, Q282W, Q282P, Q282E, Y283F, Y283N, A284T, A284G, A284P, A284V, A284R, A284D, A284E, A284S, A284H, A284K, A284I, A284W, A284M, Q292K, I299Y, Y307H, L310H, E311P, E311T, L313C, S314A, S314T, L315M, F316L, T317S, E318K, A319T, V320D, V320G, V320S, Q321A, W323R, N324S, I325T, E326K, E333D, K336R, L337I, L343V, A345V, A345T, N347L, N347S, E348A, E348S, E350K, G357R, H360L, H360A, C361R, V362A, E367G, N369I, Q370D, Q370H, Q370G, K371G, A375D, S377Y, Y387C, I397V, L399S, T405R, T409G, N410S, F424L, N429S, N429G, A436S, V439L, Q448L, C465S, K468Q, S473Y, K474T, E484D, I492V, E495G, K499E, P500L, T501P, P506S D536E or A539V by CVS numbering with reference to positions set forth in SEQ ID NO:2.

The modified valencene synthase polypeptides can contain any one or more of the recited amino acid substitutions, in any combination, with or without additional modifications.

In some examples, the modified valencene synthase polypeptide provided herein contains an amino acid replacement at one or more amino acid positions corresponding to positions 60, 97, 209, 212, 214, 221, 238, 292, 333, 345, 369, 405, 429, 473 and/or 536 with reference to positions set forth in SEQ ID NO:2. For example, amino acid substitutions (or replacements) that can be included in the modified valencene synthase polypeptides provided include, but are not limited to, V60I, V60G, N97D, F209I, F209H, F209E, F209L, F209T, M212R, M212D, M212N, M212S, M212A, M212Y, M212K, M212F, M212H, M212Q, N214D, N214E, N214S, N214L, N214Y, N214V, N214P, N214H, N214C, N214A, N214T, N214R, Y221C, Y221V, Y221Q, Y221F, Y221S, Y221N, Y221T, Y221P, Y221L, Y221K, Y221W, Y221E, Y221V, E238D, Q292K, N97D, E333D, A345V, A345T, N369I, T405R, N429S, N429G, S473Y, and/or D536E by CVS numbering with reference to positions set forth in SEQ ID NO:2.

Other amino acid replacements also can be included in the modified valencene synthase polypeptides provided herein. For example, the modified valencene synthase polypeptides contains an amino acid replacement at one or more amino acid positions corresponding to positions 24, 38, 58, 60, 88, 93, 97, 98, 125, 173, 184, 209, 212, 214, 219, 221, 238, 252, 292, 321, 333, 345, 369, 377, 405, 429, 436, 501 and/or 536 with reference to positions set forth in SEQ ID NO:2. As described herein in Example 3, such amino acid positions are identified experimentally or by modeling as being residues targeted for mutagenesis. For example, the residues are located as surface residues and/or are identified as being either tolerated (e.g. having neutral effects on enzyme activity) or resulting in improved valencene production. For example, amino acid substitutions (or replacements) that can be included in the modified valencene synthase polypeptides provided include, but are not limited to, K24A, K24Q, D28G, Q38V, Q38A, Q38N, K58Q, K58R, K58P, K58E, K58A, V60I, V60G, K88Q, K88A, Y93H, N97D, R98K, K125A, K125Q, K173E, K173Q, K173A, K184R, F209I, F209H, F209E, F209L, F209T, M212R, M212D, M212N, M212S, M212A, N214D, N214E, N214S, N214L, N214Y, N214V, M212Y, M212K, M212F, M212H, M212Q, H219D, H219A, H219L, H219C, H219W, H219R, H219S, H219F, H219E, Y221C, Y221V, Y221Q, Y221F, Y221S, Y221N, Y221T, Y221P, Y221L, Y221K, Y221W, Y221E, Y221V, N227S, E238D, K252Q, Q292K, Q321A, E333D, A345V, A345T, N369I, S377Y, T405R, N429S, N429G, A436S, T501P, and/or D536E by CVS numbering with reference to positions set forth in SEQ ID NO:2.

In some examples herein, modified valencene synthase polypeptides contain amino acid replacements at positions 60, 209, 238 and 292. For example, amino acid substitutions (or replacements) that can be included in the modified valencene synthase polypeptides provided include, but are not limited to, a replacement at position V60, for example amino acid replacement V60I or V60G; a replacement at position F209, for example amino acid replacement F209I, F209H, F209E, F209L, F209T; a replacement at position E238, for example amino acid replacement E238D; and a replacement at position Q292, for example amino acid replacement Q292K, each by CVS numbering with reference to positions set forth in SEQ ID NO:2. In other examples herein, modified valencene synthase polypeptides contain amino acid replacements at positions 60, 125, 173, 209, 238, 252 and 292. For example, amino acid substitutions (or replacements) that can be included in the modified valencene synthase polypeptides provided include, but are not limited to, a replacement at position V60, for example amino acid replacement V60I or V60G; a replacement at position K125, for example amino acid replacement K125A or K125Q; a replacement at position K173, for example amino acid replacement K173E, K173Q or K173A; a replacement at position F209, for example amino acid replacement F209I, F209H, F209E, F209L, F209T; a replacement at position E238, for example amino acid replacement E238D; a replacement at position K252, for example amino acid replacement K252Q; and a replacement at position Q292, for example amino acid replacement Q292K, each with reference to positions set forth in SEQ ID NO:2.

Table 3 provides non-limiting examples of exemplary amino acid replacements at the identified positions, corresponding to amino acid positions of a valencene synthase polypeptide as set forth in SEQ ID NO:2. Included amongst these are exemplary single and combination mutations. In reference to such mutations, the first amino acid (one-letter abbreviation) corresponds to the amino acid that is replaced, the number corresponds to the position in the valencene synthase polypeptide sequence with reference to SEQ ID NO: 2, and the second amino acid (one-letter abbreviation) corresponds to the amino acid selected that replaces the first amino acid at that position. These mutations can be incorporated into any valencene synthase, including, for example, the wild-type valencene synthases set forth in SEQ ID NOS: 2, 289-291, 752 or 886, or a variant thereof. In some example, the modifications are incorporated into the valencene synthase set forth in SEQ ID NO:2. This results in the exemplary valencene synthase mutants provided in the Table, and encoding nucleic acid molecules. Also provided is the sequence identifier (SEQ ID NO) that sets forth exemplary amino acid sequences and encoding nucleic acid sequences of the modified valencene synthase polypeptides.

TABLE 3

| Mut No. | Mutation(s) | SEQ ID NO aa | SEQ ID NO nt |
|---|---|---|---|
| V1 | N214D/S473Y | 6 | 131 |
| V2 | T405R | 7 | 132 |
| V3 | A345V/D536E | 8 | 133 |
| V4 | Y221C | 9 | 134 |
| V5 | E238D | 10 | 135 |
| V6 | F209I | 11 | 136 |
| V7 | N97D | 12 | 137 |
| V8 | E333D/N369I | 13 | 138 |
| V9 | N214D/T405R | 14 | 139 |
| V10 | N214D/A345V/T405R/D536E | 15 | 140 |
| V12 | V60I/N214D/A345T/T405R | 16 | 141 |
| V13 | N214D/T405R/N429S | 17 | 142 |
| V14 | N214D/Q292K/T405R | 18 | 143 |
| V15 | V60G/N214D/T405R | 19 | 144 |
| V16 | V60I/N214D/A345T/T405R/N429G | 20 | 145 |
| V17 | V60I/M212R/N214D/Y221V/A345T/T405R/N429G | 21 | 146 |
| V18 | K24A/Q38A/K58A/V60I/K88A/Y93H/N97D/R98K/K125A/K173A/K184R/F209I/M212R/N214D/H219D/Y221V/E238D/K252A/Q292K/Q321A/E333D/A345T/N369I/S377Y/T405R/N429G/A436S/T501P/D536E | 3 | 128 |
| V19 | K24Q/Q38N/K58Q/V60I/K88Q/Y93H/N97D/R98K/K125Q/K173Q/K184R/F209I/M212R/N214D/H219D/Y221V/E238D/K252Q/Q292K/Q321A/E333D/A345T/N369I/S377Y/T405R/N429G/A436S/T501P/D536E | 4 | 129 |
| V20 | K24A/Q38A/K58A/V60I/K88A/Y93H/N97D/R98K/K125A/K173A/K184R/F209I/M212R/N214D/H219D/Y221V/E238D/K252A/Q292K/V320S/Q321A/E326K/E333D/A345T/N369I/S377Y/T405R/N429G/A436S/T501P/D536E | 22 | 147 |
| V21 | K24A/Q38A/R50G/K58A/V60I/K88A/Y93H/N97D/R98K/K125A/K173A/K184R/F209I/M212R/N214D/H219D/Y221V/E238D/K252A/Q292K/V320G/Q321A/E333D/A345T/N369I/S377Y/T405R/N429G/A436S/T501P/D536E | 23 | 148 |
| V22 | K24A/Q38A/K58A/V60I/K88A/Y93H/N97D/R98K/K125A/K173A/K184R/F209I/M212R/N214D/H219D/Y221V/E238D/K252A/Q292K/L315M/Q321A/E333D/A345T/N369I/S377Y/T405R/N429G/A436S/T501P/D536E | 24 | 149 |
| V23 | K24A/Q38A/K58A/V60I/K88A/Y93H/N97D/R98K/K125A/K173A/K184R/F209I/M212R/N214D/H219D/Y221V/E238D/K252A/Q292K/L315M/Q321A/E333D/A345T/N369I/S377Y/T405R/N429G/A436S/T501P/D536E | 24 | 168 |
| V24 | K24A/Q38A/K58A/V60I/K88A/Y93H/N97D/R98K/K125A/K173A/K184R/F209I/M212R/N214D/H219D/Y221V/E238D/K252A/Q292K/V320G/Q321A/E333D/A345T/N369I/S377Y/T405R/N429G/A436S/T501P/D536E | 25 | 150 |
| V25 | K24A/Q38A/K58A/V60I/K88A/Y93H/N97D/R98K/K125A/K173A/K184R/F209I/M212R/N214D/H219D/Y221V/E238D/K252A/Q292K/Q321A/E333D/A345T/N369I/S377Y/T405R/N429G/A436S/T501P/D536E | 3 | 151 |
| V26 | K24A/Q38A/K58A/V60I/K88A/Y93H/N97D/R98K/K125A/K173A/K184R/F209I/M212R/N214D/H219D/Y221V/E238D/K252A/Q292K/Q321A/E333D/A345T/N369I/S377Y/T405R/N429G/A436S/T501P/D536E | 3 | 152 |
| V27 | K24A/Q38A/K58A/V60I/K88A/Y93H/N97D/R98K/K125A/K173A/K184R/F209I/M212R/N214D/H219D/Y221V/E238D/K252A/Q292K/Q321A/E333D/A345T/G357R/N369I/S377Y/T405R/N429G/A436S/T501P/D536E | 26 | 153 |
| V28 | K24A/Q38A/K58A/V60I/K88A/Y93H/N97D/R98K/K125A/K173A/K184R/F209I/M212R/N214D/H219D/Y221V/E238D/K252A/Q292K/Q321A/E333D/A345T/N369I/E367G/S377Y/T405R/N429G/A436S/T501P/D536E | 27 | 154 |
| V29 | K24A/Q38A/K58A/V60I/K88A/Y93H/N97D/R98K/K125A/K173A/K184R/F209I/M212R/N214D/H219D/Y221V/E238D/K252A/Q292K/Q321A/E333D/A345T/N369I/S377Y/T405R/N429G/A436S/T501P/D536E | 3 | 155 |
| V30 | K24A/Q38A/K58A/V60I/K88A/Y93H/N97D/R98K/K125A/K173A/K184R/F209I/M212R/N214D/H219D/Y221V/E238D/K252A/Q292K/Q321A/E333D/A345T/G357R/N369I/S377Y/T405R/N429G/A436S/T501P/D536E | 26 | 156 |
| V31 | K24A/Q38A/K58A/V60I/K88A/Y93H/N97D/R98K/K125A/K173A/K184R/F209I/M212R/N214D/H219D/Y221V/E238D/K252A/Q292K/Q321A/E333D/A345T/N369I/Q370D/S377Y/T405R/N429G/A436S/T501P/D536E | 28 | 157 |
| V32 | K24A/Q38A/K58A/V60I/K88A/Y93H/N97D/R98K/K125A/K173A/K184R/F209I/M212R/N214D/H219D/Y221V/E238D/K252A/Q292K/I299Y/Q321A/E333D/A345T/N369I/S377Y/T405R/N429G/A436S/T501P/D536E | 29 | 158 |
| V33 | K24A/Q38A/K58A/V60I/K88A/Y93H/N97D/R98K/K125A/K173A/K184R/F209I/M212R/N214D/H219D/Y221V/E238D/K252A/Q292K/V320G/Q321A/E333D/A345T/N369I/S377Y/T405R/N429G/A436S/T501P/D536E | 25 | 159 |

TABLE 3-continued

| Mut No. | Mutation(s) | SEQ ID NO aa | SEQ ID NO nt |
|---|---|---|---|
| V34 | K24A/Q38A/K58A/V60I/K88A/Y93H/N97D/R98K/K125A/K173A/K184R/F209I/M212R/N214D/H219D/Y221V/E238D/K252A/Q292K/Q321A/E333D/A345T/H360L/N369I/S377Y/T405R/N429G/A436S/T501P/D536E | 30 | 160 |
| V35 | K24A/Q38A/K58A/V60I/K88A/Y93H/N97D/R98K/K125A/K173A/K184R/F209I/M212R/N214D/H219D/Y221V/E238D/K252A/Q292K/T317S/Q321A/E333D/A345T/N369I/S377Y/T405R/N429G/A436S/T501P/D536E | 31 | 161 |
| V36 | K24A/Q38A/K58A/V60I/K88A/Y93H/N97D/R98K/K125A/K173A/K184R/F209I/M212R/N214D/H219D/Y221V/E238D/K252A/Q292K/V320D/Q321A/E333D/A345T/N369I/S377Y/T405R/N429G/A436S/T501P/D536E | 32 | 162 |
| V37 | K24A/Q38A/K58A/V60I/K88A/Y93H/N97D/R98K/K125A/K173A/K184R/F209I/M212R/N214D/H219D/Y221V/E238D/K252A/Q292K/Q321A/E333D/A345T/N369I/S377Y/T405R/N429G/A436S/T501P/D536E | 3 | 163 |
| V38 | K24A/Q38A/K58A/V60I/K88A/Y93H/N97D/R98K/K125A/K173A/K184R/F209I/M212R/N214D/H219D/Y221V/E238D/K252A/Q292K/Q321A/E333D/A345T/N369I/S377Y/T405R/N429G/A436S/T501P/D536E | 3 | 164 |
| V39 | K24A/Q38A/K58A/V60I/K88A/Y93H/N97D/R98K/K125A/K173A/K184R/F209I/M212R/N214D/H219D/Y221V/E238D/K252A/Q292K/V320D/Q321A/E333D/A345T/N369I/S377Y/T405R/N429G/A436S/T501P/D536E | 32 | 167 |
| V40 | K24A/Q38V/K58A/V60I/K88A/Y93H/N97D/R98K/K125A/K173A/K184R/F209I/M212R/N214D/H219D/Y221V/E238D/K252A/Q292K/Q321A/E333D/A345T/N369I/S377Y/T405R/N429G/A436S/T501P/D536E | 33 | 165 |
| V41 | K24A/Q38A/K58A/V60I/K88A/Y93H/N97D/R98K/K125A/K173A/K184R/F209I/M212R/N214D/H219D/Y221V/E238D/K252A/Q292K/Q321A/E333D/A345T/N369I/S377Y/T405R/T409G/N429G/A436S/E495G/T501P/D536E | 34 | 166 |
| V42 | K24A/Q38A/K58A/V60I/K88A/Y93H/N97D/R98K/K125A/K173A/K184R/F209I/M212R/N214D/H219D/Y221V/E238D/K252A/P281S/Q292K/Q321A/E333D/L337I/A345T/N369I/S377Y/T405R/N429G/A436S/T501P/D536E | 35 | 169 |
| V43 | K24A/Q38A/K58A/V60I/K88A/Y93H/N97D/R98K/K125A/K173A/K184R/F209I/M212R/N214D/H219D/Y221V/E238D/K252A/Q292K/Q321A/E333D/A345T/N369I/A375D/S377Y/T405R/N429G/A436S/T501P/D536E | 36 | 170 |
| V44 | K24A/Q38A/K58A/V60I/K88A/Y93H/N97D/R98K/K125A/K173A/K184R/F209I/M212R/N214D/H219D/Y221V/E238D/K252A/Q292K/Q321A/E333D/K336R/A345T/N369I/S377Y/T405R/N429G/A436S/T501P/D536E | 37 | 171 |
| V45 | K24A/Q38A/K58A/V60I/K88A/Y93H/N97D/R98K/K125A/K173A/K184R/F209I/M212R/N214D/H219D/Y221V/E238D/K252A/Q292K/E311P/Q321A/E333D/A345T/N369I/S377Y/T405R/N429G/A436S/T501P/D536E | 38 | 172 |
| V46 | K24A/Q38A/K58A/V60I/K88A/Y93H/N97D/R98K/K125A/K173A/K184R/F209I/M212R/N214D/H219D/Y221V/E238D/K252A/Q292K/Q321A/E333D/A345T/N369I/Q370H/S377Y/T405R/N429G/A436S/T501P/D536E | 39 | 173 |
| V47 | K24A/Q38A/K58A/V60I/K88A/Y93H/N97D/R98K/K125A/K173A/K184R/F209I/M212R/N214D/H219D/Y221V/E238D/K252A/Q292K/T317S/Q321A/E333D/A345T/N369I/S377Y/T405R/N429G/A436S/T501P/D536E | 31 | 174 |
| V48 | K24A/Q38A/K58A/V60I/K88A/Y93H/N97D/R98K/K125A/K173A/K184R/F209I/M212R/N214D/H219D/Y221V/E238D/K252A/Q292K/Q321A/E333D/L343V/A345T/H360A/N369I/S377Y/T405R/N429G/A436S/T501P/D536E | 40 | 175 |
| V49 | K24A/Q38A/K58A/V60I/K88A/Y93H/N97D/R98K/K125A/K173A/K184R/F209I/M212R/N214D/H219D/Y221V/E238D/K252A/Q282S/Q292K/Q321A/E333D/A345T/N369I/S377Y/T405R/N429G/A436S/T501P/D536E | 41 | 176 |
| V50 | K24A/Q38A/K58A/V60I/K88A/Y93H/N97D/R98K/K125A/K173A/K184R/F209I/M212R/N214D/H219D/Y221V/E238D/K252A/Q292K/Q321A/E333D/A345T/N369I/K371G/S377Y/T405R/N429G/A436S/T501P/D536E | 42 | 177 |
| V51 | K24A/Q38A/K58A/V60I/K88A/Y93H/N97D/R98K/K125A/K173A/K184R/F209I/M212R/N214D/H219D/Y221V/E238D/K252A/Q292K/Q321A/E333D/A345T/N347L/N369I/S377Y/T405R/N429G/A436S/T501P/D536E | 43 | 178 |
| V52 | K24A/Q38A/K58A/V60I/K88A/Y93H/N97D/R98K/K125A/K173A/K184R/F209I/M212R/N214D/H219D/Y221V/E238D/K252A/Q292K/E311T/Q321A/E333D/A345T/N369I/S377Y/T405R/N429G/A436S/T501P/D536E | 44 | 179 |
| V53 | K24A/Q38A/K58A/V60I/K88A/Y93H/N97D/R98K/K125A/K173A/K184R/F209I/M212R/N214D/H219D/Y221V/E238D/K252A/Q282L/Q292K/Q321A/ | 45 | 180 |

TABLE 3-continued

| Mut No. | Mutation(s) | SEQ ID NO aa | SEQ ID NO nt |
|---|---|---|---|
| | E333D/A345T/N369I/S377Y/T405R/N429G/A436S/T501P/D536E | | |
| V54 | K24A/Q38A/K58A/V60I/K88A/Y93H/N97D/R98K/K125A/K173A/K184R/F209I/M212R/N214D/H219D/Y221V/E238D/K252A/Q292K/S314T/Q321A/E333D/A345T/N369I/S377Y/T405R/N429G/A436S/T501P/D536E | 46 | 181 |
| V55 | K24A/Q38A/K58A/V60I/K88A/Y93H/N97D/R98K/K125A/K173A/K184R/F209I/M212R/N214D/H219D/Y221V/E238D/K252A/Q292K/Q321A/E333D/A345T/N369I/Q370G/S377Y/T405R/N429G/A436S/T501P/D536E | 47 | 182 |
| V56 | K24A/Q38A/K58A/V60I/K88A/Y93H/N97D/R98K/K125A/K173A/K184R/F209I/M212R/N214D/H219D/Y221V/E238D/K252A/Q292K/L310H/Q321A/E333D/A345T/V362A/N369I/S377Y/T405R/N429G/A436S/T501P/D536E | 48 | 183 |
| V57 | K24A/Q38A/K58A/V60I/F78L/K88A/Y93H/N97D/R98K/K125A/K173A/K184R/F209I/M212R/N214D/H219D/Y221V/E238D/K252A/Q292K/L313C/Q321A/E333D/A345T/N369I/S377Y/T405R/N429G/A436S/T501P/D536E | 49 | 184 |
| V58 and V59 | K24Q/Q38N/K58Q/V60I/K88Q/Y93H/N97D/R98K/K125Q/K173Q/K184R/F209I/M212R/N214D/H219D/Y221V/E238D/K252Q/P281S/Q292K/I299Y/L310H/E311P/Q321A/E333D/A345T/N369I/S377Y/T405R/N429G/A436S/T501P/D536E | 50 | 185 |
| V60 | K24Q/Q38N/K58Q/V60I/K88Q/Y93H/N97D/R98K/K125Q/K173Q/K184R/F209I/M212R/N214D/H219D/Y221V/E238D/K252Q/P281S/Q282L/Q292K/L310H/Q321A/E333D/A345T/N369I/S377Y/T405R/N429G/A436S/T501P/D536E | 51 | 186 |
| V61 | K24Q/Q38N/K58Q/V60I/K88Q/Y93H/N97D/R98K/K125Q/K173Q/K184R/F209I/M212R/N214D/H219D/Y221V/E238D/K252Q/P281S/Q282L/Q292K/I299Y/E311P/Q321A/E333D/A345T/N369I/S377Y/T405R/N429G/A436S/T501P/D536E | 52 | 187 |
| V62 | K24Q/Q38N/K58Q/V60I/K88Q/Y93H/N97D/R98K/K125Q/K173Q/K184R/F209I/M212R/N214D/H219D/Y221V/E238D/K252Q/P281S/Q292K/L313C/S314T/L315M/T317S/Q321A/E333D/A345T/N369I/S377Y/T405R/N429G/A436S/T501P/D536E | 53 | 188 |
| V63 | K24Q/Q38N/K58Q/V60I/K88Q/Y93H/N97D/R98K/K125Q/K173Q/K184R/F209I/M212R/N214D/H219D/Y221V/E238D/K252Q/P281S/Q292K/Q321A/E333D/K336R/A345T/N347L/G357R/N369I/S377Y/T405R/N429G/A436S/T501P/D536E | 54 | 189 |
| V64 | K24Q/Q38N/K58Q/V60I/K88Q/Y93H/N97D/R98K/K125Q/K173Q/K184R/F209I/M212R/N214D/H219D/Y221V/E238D/K252Q/Q292K/L310H/E311T/L313C/S314T/L315M/T317S/V320G/Q321A/E333D/A345T/N369I/S377Y/T405R/N429G/A436S/T501P/D536E | 55 | 190 |
| V65 | K24Q/Q38N/K58Q/V60I/K88Q/Y93H/N97D/R98K/K125Q/K173Q/K184R/F209I/M212R/N214D/H219D/Y221V/E238D/K252Q/Q292K/L310H/E311T/L313C/S314T/L315M/T317S/V320G/Q321A/E333D/A345T/N369I/S377Y/T405R/N429G/A436S/T501P/D536E | 55 | 191 |
| V66 | K24Q/Q38N/K58Q/V60I/K88Q/Y93H/N97D/R98K/K125Q/K173Q/K184R/F209I/M212R/N214D/H219D/Y221V/E238D/K252Q/P281S/Q292K/T317S/Q321A/E333D/K336R/L337I/A345T/N347L/G357R/N369I/S377Y/T405R/N429G/A436S/T501P/D536E | 56 | 192 |
| V67 | K24Q/Q38N/K58Q/V60I/K88Q/Y93H/N97D/R98K/K125Q/K173Q/K184R/F209I/M212R/N214D/H219D/Y221V/E238D/K252Q/Q292K/T317S/Q321A/E333D/K336R/L337I/A345T/G357R/N369I/S377Y/T405R/N429G/A436S/T501P/D536E | 57 | 193 |
| V68 | K24Q/Q38N/K58Q/V60I/K88Q/Y93H/N97D/R98K/K125Q/K173Q/K184R/F209I/M212R/N214D/H219D/Y221V/E238D/K252Q/P281S/Q292K/T317S/Q321A/E333D/K336R/A345T/N347L/G357R/N369I/S377Y/T405R/N429G/A436S/T501P/D536E | 58 | 194 |
| V69 | K24Q/Q38N/K58Q/V60I/K88Q/Y93H/N97D/R98K/K125Q/K173Q/K184R/F209I/M212R/N214D/H219D/Y221V/E238D/K252Q/P281S/Q292K/T317S/Q321A/E333D/A345T/G357R/N369I/S377Y/T405R/N429G/A436S/T501P/D536E | 59 | 195 |
| V70 | K24Q/Q38N/K58Q/V60I/K88Q/Y93H/N97D/R98K/K125Q/K173Q/K184R/F209I/M212R/N214D/H219D/Y221V/E238D/K252Q/P281S/Q292K/L310H/E311T/L313C/T317S/V320G/Q321A/E333D/A345T/N369I/S377Y/T405R/N429G/A436S/T501P/D536E | 60 | 196 |
| V71 | K24Q/Q38N/K58Q/V60I/K88Q/Y93H/N97D/R98K/K125Q/K173Q/K184R/F209I/M212R/N214D/H219D/Y221V/E238D/K252Q/P281S/Q292K/L313C/S314T/L315M/T317S/Q321A/E333D/K336R/A345T/N347L G357R/N369I/S377Y/T405R/N429G/A436S/T501P/D536E | 61 | 197 |
| V72 | K24Q/Q38N/K58Q/V60I/K88Q/Y93H/N97D/R98K/K125Q/K173Q/K184R/F209I/M212R/N214D/H219D/Y221V/E238D/K252Q/Q292K/Q321A/E333D/A345T/N369I/Q370D/A375D/S377Y/T405R/T409G/N429G/A436S/E495G/T501P/D536E | 62 | 198 |

TABLE 3-continued

| Mut No. | Mutation(s) | SEQ ID NO aa | SEQ ID NO nt |
|---|---|---|---|
| V73 and V74 | K24Q/Q38N/K58Q/V60I/K88Q/Y93H/N97D/R98K/K125Q/K173Q/K184R/F209I/M212R/N214D/H219D/Y221V/E238D/K252Q/P281S/Q292K/L313C/S314T/L315M/T317S/Q321A/E333D/K336R/L337I/A345T/N347L/G357R/N369I/S377Y/T405R/N429G/A436S/T501P/D536E | 63 | 199 |
| V75 and V76 | K24Q/Q38N/K58Q/V60I/K88Q/Y93H/N97D/R98K/K125Q/K173Q/K184R/F209I/M212R/N214D/H219D/Y221V/E238D/K252Q/P281S/Q292K/L313C/S314T/L315M/T317S/Q321A/E333D/K336R/L337I/A345T/G357R/N369I/S377Y/T405R/N429G/A436S/T501P/D536E | 5 | 130 |
| V77 | S2R/S3D/G4K/E5G/F7C/K24Q/Q38N/K58Q/V60I/K88Q/Y93H/N97D/R98K/K125Q/K173Q/K184R/F209I/M212R/N214D/H219D/Y221V/E238D/K252Q/Q292K/Q321A/E333D/A345T/N369I/S377Y/T405R/N429G/A436S/T501P/D536E | 64 | 200 |
| V78 | S2E/S3G/G4N/E5S/T6V/F7Q/K24Q/Q38N/K58Q/V60I/K88Q/Y93H/N97D/R98K/K125Q/K173Q/K184R/F209I/M212R/N214D/H219D/Y221V/E238D/K252Q/Q292K/Q321A/E333D/A345T/N369I/S377Y/T405R/F424L/N429G/A436S/T501P/D536E | 65 | 201 |
| V79 | S2K/S3R/G4V/E5G/T6R/F7A/K24Q/Q38N/K58Q/V60I/K88Q/Y93H/N97D/R98K/K125Q/K173Q/K184R/F209I/M212R/N214D/H219D/Y221V/E238D/K252Q/Q292K/Q321A/E333D/A345T/N369I/S377Y/T405R/N429G/A436S/T501P/D536E | 66 | 202 |
| V80 or V81 | K24A/Q38A/K58A/V60I/K88A/Y93H/N97D/R98K/K125A/K173A/K184R/F209I/M212R/N214D/H219D/Y221V/E238D/K252A/D274M/Q292K/Q321A/E333D/A345T/N369I/S377Y/T405R/N429G/A436S/T501P/D536E | 68 | 204 |
| V82 or V83 | K24A/Q38A/K58A/V60I/K88A/Y93H/N97D/R98K/K125A/K173A/K184R/F209I/M212R/N214D/H219D/Y221V/E238D/K252A/D274N/Q292K/Q321A/E333D/A345T/N369I/S377Y/T405R/N429G/A436S/T501P/D536E | 69 | 205 |
| V85 | K24A/Q38A/K58A/V60I/K88A/Y93H/N97D/R98K/K125A/K173A/K184R/F209I/M212R/N214D/H219D/Y221V/E238D/K252A/D274S/Q292K/Q321A/E333D/A345T/N369I/S377Y/T405R/N429G/A436S/T501P/D536E | 70 | 206 |
| V86 | K24A/Q38A/K58A/V60I/K88A/Y93H/N97D/R98K/K125A/K173A/K184R/F209I/M212R/N214D/H219D/Y221V/E238D/K252A/D274F/Q292K/Q321A/E333D/A345T/N369I/S377Y/T405R/N429G/A436S/T501P/D536E | 71 | 207 |
| V87 or V88 | K24A/Q38A/K58A/V60I/K88A/Y93H/N97D/R98K/K125A/K173A/K184R/F209I/M212R/N214D/H219D/Y221V/E238D/K252A/D274G/Q292K/Q321A/E333D/A345T/N369I/S377Y/T405R/N429G/A436S/T501P/D536E | 72 | 208 |
| V89 | K24A/Q38A/K58A/V60I/K88A/Y93H/N97D/R98K/K125A/K173A/K184R/F209I/M212R/N214D/H219D/Y221V/E238D/K252A/D274G/Q292K/Q321A/E333D/A345T/N369I/S377Y/T405R/N429G/A436S/T501P/D536E | 72 | 211 |
| V90 | K24A/Q38A/K58A/V60I/K88A/Y93H/N97D/R98K/K125A/K173A/K184R/F209I/M212R/N214D/H219D/Y221V/E238D/K252A/D274G/Q292K/Q321A/E333D/A345T/N369I/S377Y/T405R/N429G/A436S/T501P/D536E | 72 | 212 |
| V91 | K24A/Q38A/K58A/V60I/K88A/Y93H/N97D/R98K/K125A/K173A/K184R/F209I/M212R/N214D/H219D/Y221V/E238D/K252A/D274H/Q292K/Q321A/E333D/A345T/N369I/S377Y/T405R/N429G/A436S/T501P/D536E | 73 | 209 |
| V93 | K24A/Q38A/K58A/V60I/K88A/Y93H/N97D/R98K/K125A/K173A/K184R/F209I/M212R/N214D/H219D/Y221V/E238D/K252A/D274E/Q292K/Q321A/E333D/A345T/N369I/S377Y/T405R/N429G/A436S/T501P/D536E | 74 | 210 |
| V94 | K24A/Q38A/K58A/V60I/K88A/Y93H/N97D/R98K/K125A/K173A/K184R/F209I/M212R/N214D/H219D/Y221V/E238D/K252A/F279S/Q292K/Q321A/E333D/A345T/N369I/S377Y/T405R/N429G/A436S/T501P/D536E | 75 | 213 |
| V95 | K24A/Q38A/K58A/V60I/K88A/Y93H/N97D/R98K/K125A/K173A/K184R/F209I/M212R/N214D/H219D/Y221V/E238D/K252A/F279S/Q292K/Q321A/E333D/A345T/N369I/S377Y/T405R/N429G/A436S/T501P/D536E | 75 | 223 |
| V96 | K24A/Q38A/K58A/V60I/K88A/Y93H/N97D/R98K/K125A/K173A/K184R/F209I/M212R/N214D/H219D/Y221V/E238D/K252A/F279S/Q292K/Q321A/E333D/A345T/N369I/S377Y/T405R/N429G/A436S/T501P/D536E | 75 | 232 |
| V97 | K24A/Q38A/K58A/V60I/K88A/Y93H/N97D/R98K/K125A/K173A/K184R/F209I/M212R/N214D/H219D/Y221V/E238D/K252A/F279I/Q292K/Q321A/E333D/A345T/N369I/S377Y/T405R/N429G/A436S/T501P/D536E | 76 | 214 |
| V99/V100 | K24A/Q38A/K58A/V60I/K88A/Y93H/N97D/R98K/K125A/K173A/K184R/F209I/M212R/N214D/H219D/Y221V/E238D/K252A/F279P/Q292K/Q321A/E333D/A345T/N369I/S377Y/T405R/N429G/A436S/T501P/D536E | 77 | 215 |
| V101 | K24A/Q38A/K58A/V60I/K88A/Y93H/N97D/R98K/K125A/K173A/K184R/F209I/M212R/N214D/H219D/Y221V/E238D/K252A/F279D/Q292K/Q321A/E333D/A345T/N369I/S377Y/T405R/N429G/A436S/T501P/D536E | 78 | 216 |
| V102 | K24A/Q38A/K58A/V60I/K88A/Y93H/N97D/R98K/K125A/K173A/K184R/F209I/M212R/N214D/H219D/Y221V/E238D/K252A/F279L/Q292K/Q321A/E333D/A345T/N369I/S377Y/T405R/N429G/A436S/T501P/D536E | 79 | 217 |
| V103 or V104 | K24A/Q38A/K58A/V60I/K88A/Y93H/N97D/R98K/K125A/K173A/K184R/F209I/M212R/N214D/H219D/Y221V/E238D/K252A/F279L/Q292K/Q321A/E333D/A345T/N369I/S377Y/T405R/N429G/A436S/T501P/D536E | 79 | 226 |
| V105 | K24A/Q38A/K58A/V60I/K88A/Y93H/N97D/R98K/K125A/K173A/K184R/F209I/M212R/N214D/H219D/Y221V/E238D/K252A/F279N/Q292K/Q321A/E333D/A345T/N369I/S377Y/T405R/N429G/A436S/T501P/D536E | 80 | 218 |

TABLE 3-continued

| Mut No. | Mutation(s) | SEQ ID NO aa | SEQ ID NO nt |
|---|---|---|---|
| V106 | K24A/Q38A/K58A/V60I/K88A/Y93H/N97D/R98K/K125A/K173A/K184R/F209I/M212R/N214D/H219D/Y221V/E238D/K252A/F279N/Q292K/Q321A/E333D/A345T/N369I/S377Y/T405R/N429G/A436S/T501P/D536E | 80 | 227 |
| V107 | K24A/Q38A/K58A/V60I/K88A/Y93H/N97D/R98K/K125A/K173A/K184R/F209I/M212R/N214D/H219D/Y221V/E238D/K252A/A281W/Q292K/Q321A/E333D/A345T/E350K/N369I/S377Y/T405R/N429G/A436S/T501P/D536E | 81 | 219 |
| V108 | K24A/Q38A/K58A/V60I/K88A/Y93H/N97D/R98K/K125A/K173A/K184R/F209I/M212R/N214D/H219D/Y221V/E238D/K252A/F279M/Q292K/Q321A/E333D/A345T/N369I/S377Y/T405R/N429G/A436S/T501P/D536E | 82 | 220 |
| V109 | K24A/Q38A/K58A/V60I/K88A/Y93H/N97D/R98K/K125A/K173A/K184R/F209I/M212R/N214D/H219D/Y221V/E238D/K252A/F279H/Q292K/Q321A/E333D/A345T/N369I/S377Y/T405R/N429G/A436S/T501P/D536E | 83 | 221 |
| V110 or V111 | K24A/Q38A/K58A/V60I/K88A/Y93H/N97D/R98K/K125A/K173A/K184R/F209I/M212R/N214D/H219D/Y221V/E238D/K252A/F279C/Q292K/Q321A/E333D/A345T/N369I/S377Y/T405R/N429G/A436S/T501P/D536E | 84 | 222 |
| V112 | K24A/Q38A/K58A/V60I/K88A/Y93H/N97D/R98K/K125A/K173A/K184R/F209I/M212R/N214D/H219D/Y221V/E238D/K252A/P281W/Q292K/Q321A/E333D/A345T/N369I/S377Y/T405R/N429G/A436S/T501P/D536E | 85 | 224 |
| V113 | K24A/Q38A/K58A/V60I/K88A/Y93H/N97D/R98K/K125A/K173A/K184R/F209I/M212R/N214D/H219D/Y221V/E238D/K252A/F279A/Q292K/Q321A/E333D/A345T/N369I/S377Y/T405R/N429G/A436S/T501P/D536E | 86 | 225 |
| V114 | K24A/Q38A/K58A/V60I/K88A/Y93H/N97D/R98K/K125A/K173A/K184R/F209I/M212R/N214D/H219D/Y221V/E238D/K252A/F279G/Q292K/Q321A/E333D/A345T/N369I/S377Y/T405R/N429G/A436S/T501P/D536E | 87 | 228 |
| V115 | K24A/Q38A/K58A/V60I/K88A/Y93H/N97D/R98K/K125A/K173A/K184R/F209I/M212R/N214D/H219D/Y221V/E238D/K252A/F279G/Q292K/Q321A/E333D/A345T/N369I/S377Y/T405R/N429G/A436S/T501P/D536E | 87 | 230 |
| V116 | K24A/Q38A/K58A/V60I/K88A/Y93H/N97D/R98K/K125A/K173A/K184R/F209I/M212R/N214D/H219D/Y221V/E238D/K252A/Q292K/Q321A/E333D/A345T/N369I/S377Y/T405R/N429G/A436S/T501P/D536E | 3 | 231 |
| V117 | K24A/Q38A/K58A/V60I/K88A/Y93H/N97D/R98K/K125A/K173A/K184R/F209I/M212R/N214D/H219D/Y221V/E238D/K252A/F279W/Q292K/Q321A/E333D/A345T/N369I/S377Y/T405R/N429G/A436S/T501P/D536E | 88 | 233 |
| V118 | K24A/Q38A/K58A/V60I/K88A/Y93H/N97D/R98K/K125A/K173A/K184R/F209I/M212R/N214D/H219D/Y221V/E238D/K252A/P281H/Q292K/Q321A/E333D/A345T/N369I/S377Y/T405R/N429G/A436S/T501P/D536E | 89 | 234 |
| V119 | K24A/Q38A/K58A/V60I/K88A/Y93H/N97D/R98K/K125A/K173A/K184R/F209I/M212R/N214D/H219D/Y221V/E238D/K252A/P281K/Q292K/Q321A/E333D/A345T/N369I/S377Y/T405R/N429G/A436S/T501P/D536E | 90 | 235 |
| V120 | K24A/Q38A/K58A/V60I/K88A/Y93H/N97D/R98K/K125A/K173A/K184R/F209I/M212R/N214D/H219D/Y221V/E238D/K252A/P281K/Q292K/Q321A/E333D/A345T/N369I/S377Y/T405R/N429G/A436S/T501P/D536E | 90 | 245 |
| V121 | K24A/Q38A/K58A/V60I/K88A/Y93H/N97D/R98K/K125A/K173A/K184R/F209I/M212R/N214D/H219D/Y221V/E238D/K252A/P281A/Q292K/Q321A/E333D/A345T/N369I/S377Y/T405R/N429G/A436S/T501P/D536E | 91 | 236 |
| V122 or V123 | K24A/Q38A/K58A/V60I/K88A/Y93H/N97D/R98K/K125A/K173A/K184R/F209I/M212R/N214D/H219D/Y221V/E238D/K252A/P281A/Q292K/Q321A/E333D/A345T/N369I/S377Y/T405R/N429G/A436S/T501P/D536E | 91 | 242 |
| V124 | K24A/Q38A/K58A/V60I/K88A/Y93H/N97D/R98K/K125A/K173A/K184R/F209I/M212R/N214D/H219D/Y221V/E238D/K252A/P281S/Q292K/Q321A/E333D/A345T/N369I/S377Y/T405R/N429G/A436S/T501P/D536E | 92 | 237 |
| V125 | K24A/Q38A/K58A/V60I/K88A/Y93H/N97D/R98K/K125A/K173A/K184R/F209I/M212R/N214D/H219D/Y221V/E238D/K252A/P281S/Q292K/Q321A/E333D/A345T/N369I/S377Y/T405R/N429G/A436S/T501P/D536E | 92 | 250 |
| V126 | K24A/Q38A/K58A/V60I/K88A/Y93H/N97D/R98K/K125A/K173A/K184R/F209I/M212R/N214D/H219D/Y221V/E238D/K252A/P281W/Y283F/Q292K/Q321A/E333D/A345T/N369I/S377Y/T405R/N429G/A436S/T501P/D536E | 93 | 238 |
| V127 | K24A/Q38A/K58A/V60I/K88A/Y93H/N97D/R98K/K125A/K173A/K184R/F209I/M212R/N214D/H219D/Y221V/E238D/K252A/P281A/Q282P/Q292K/Q321A/E333D/A345T/N369I/S377Y/T405R/N429G/A436S/T501P/D536E | 94 | 239 |
| V128 | K24A/Q38A/K58A/V60I/K88A/Y93H/N97D/R98K/K125A/K173A/K184R/F209I/M212R/N214D/H219D/Y221V/E238D/K252A/Q292K/F316L/Q321A/E333D/A345T/N369I/S377Y/T405R/N429G/A436S/T501P/D536E | 95 | 240 |
| V129 | K24A/Q38A/K58A/V60I/K88A/Y93H/N97D/R98K/K125A/K173A/K184R/F209I/M212R/N214D/H219D/Y221V/E238D/K252A/E280L/Q292K/Q321A/E333D/A345T/N369I/S377Y/T405R/N429G/A436S/T501P/D536E | 96 | 241 |
| V131 | K24A/Q38A/K58A/V60I/K88A/Y93H/N97D/R98K/K125A/K173A/K184R/F209I/M212R/N214D/H219D/Y221V/E238D/K252A/P281L/Q292K/Q321A/E333D/A345T/N369I/S377Y/T405R/N429G/A436S/T501P/D536E | 97 | 243 |
| V132 | K24A/Q38A/K58A/V60I/K88A/Y93H/N97D/R98K/K125A/K173A/K184R/F209I/M212R/N214D/H219D/Y221V/E238D/K252A/P281L/Q292K/Q321A/E333D/A345T/N369I/S377Y/T405R/N429G/A436S/T501P/D536E | 97 | 246 |

TABLE 3-continued

| Mut No. | Mutation(s) | SEQ ID NO aa | SEQ ID NO nt |
|---|---|---|---|
| V133 | K24A/Q38A/K58A/V60I/K88A/Y93H/N97D/R98K/K125A/K173A/K184R/F209I/M212R/N214D/H219D/Y221V/E238D/K252A/Q292K/Q321A/E333D/A345T/N369I/S377Y/T405R/N429G/A436S/T501P/D536E | 3 | 247 |
| V134 | K24A/Q38A/K58A/V60I/K88A/Y93H/N97D/R98K/K125A/K173A/K184R/F209I/M212R/N214D/H219D/Y221V/E238D/K252A/Q292K/Q321A/E333D/A345T/N369I/S377Y/T405R/N429G/A436S/T501P/D536E | 3 | 248 |
| V135 | K24A/Q38A/K58A/V60I/K88A/Y93H/N97D/R98K/K125A/K173A/K184R/F209I/M212R/N214D/H219D/Y221V/E238D/K252A/P281Y/Q292K/Q321A/E333D/A345T/N369I/S377Y/T405R/N429G/A436S/T501P/D536E | 98 | 244 |
| V137 | K24A/Q38A/K58A/V60I/K88A/Y93H/N97D/R98K/K125A/K173A/K184R/F209I/M212R/N214D/H219D/Y221V/E238D/K252A/P281L/Q282P/Q292K/Q321A/E333D/A345T/N369I/S377Y/T405R/N429G/A436S/T501P/D536E | 99 | 249 |
| V138 or V139 | K24A/Q38A/K58A/V60I/K88A/Y93H/N97D/R98K/K125A/K173A/K184R/F209I/M212R/N214D/H219D/Y221V/E238D/K252A/Q282S/Q292K/Q321A/E333D/A345T/N369I/S377Y/T405R/N429G/A436S/T501P/D536E | 100 | 251 |
| V140 | K24A/Q38A/K58A/V60I/K88A/Y93H/N97D/R98K/K125A/K173A/K184R/F209I/M212R/N214D/H219D/Y221V/E238D/K252A/Q282S/Q292K/Q321A/E333D/A345T/N369I/S377Y/T405R/N429G/A436S/T501P/D536E | 100 | 258 |
| V141 | K24A/Q38A/K58A/V60I/K88A/Y93H/N97D/R98K/K125A/K173A/K184R/F209I/M212R/N214D/H219D/Y221V/E238D/K252A/Q282A/Q292K/Q321A/E333D/A345T/N369I/S377Y/T405R/N429G/A436S/T501P/D536E | 101 | 252 |
| V142 | K24A/Q38A/K58A/V60I/K88A/Y93H/N97D/R98K/K125A/K173A/K184R/F209I/M212R/N214D/H219D/Y221V/E238D/K252A/Q282A/Q292K/Q321A/E333D/A345T/N369I/S377Y/T405R/N429G/A436S/T501P/D536E | 101 | 256 |
| V143 | K24A/Q38A/K58A/V60I/K88A/Y93H/N97D/R98K/K125A/K173A/K184R/F209I/M212R/N214D/H219D/Y221V/E238D/K252A/Q282I/Q292K/Q321A/E333D/A345T/N369I/S377Y/T405R/N429G/A436S/T501P/D536E | 102 | 253 |
| V144 | K24A/Q38A/K58A/V60I/K88A/Y93H/N97D/R98K/K125A/K173A/K184R/F209I/M212R/N214D/H219D/Y221V/E238D/K252A/Q282R/Q292K/Q321A/E333D/A345T/N369I/S377Y/T405R/N429G/A436S/T501P/D536E | 103 | 254 |
| V145 | K24A/Q38A/K58A/V60I/K88A/Y93H/N97D/R98K/K125A/K173A/K184R/F209I/M212R/N214D/H219D/Y221V/E238D/K252A/Q282R/Q292K/Q321A/E333D/A345T/N369I/S377Y/T405R/N429G/A436S/T501P/D536E | 103 | 260 |
| V146 | K24A/Q38A/K58A/V60I/K88A/Y93H/N97D/R98K/K125A/K173A/K184R/F209I/M212R/N214D/H219D/Y221V/E238D/K252A/Q282Y/Q292K/Q321A/E333D/A345T/N369I/S377Y/T405R/N429G/A436S/T501P/D536E | 104 | 255 |
| V147 | K24A/Q38A/K58A/V60I/K88A/Y93H/N97D/R98K/K125A/K173A/K184R/F209I/M212R/N214D/H219D/Y221V/E238D/K252A/Q282L/Q292K/Q321A/E333D/A345T/N369I/S377Y/T405R/N429G/A436S/T501P/D536E | 105 | 257 |
| V148 | K24A/Q38A/K58A/V60I/K88A/Y93H/N97D/R98K/K125A/K173A/K184R/F209I/M212R/N214D/H219D/Y221V/E238D/K252A/Q282L/Q292K/Q321A/E333D/A345T/N369I/S377Y/T405R/N429G/A436S/T501P/D536E | 105 | 259 |
| V149 | K24A/Q38A/K58A/V60I/K88A/Y93H/N97D/R98K/K125A/K173A/K184R/F209I/M212R/N214D/H219D/Y221V/E238D/K252A/Q282G/Q292K/Q321A/E333D/A345T/N369I/S377Y/T405R/N429G/A436S/T501P/D536E | 106 | 261 |
| V150 | K24A/Q38A/K58A/V60I/K88A/Y93H/N97D/R98K/K125A/K173A/K184R/F209I/M212R/N214D/H219D/Y221V/E238D/K252A/Q282G/Q292K/Q321A/N324S/E333D/A345T/N369I/S377Y/T405R/N429G/A436S/T501P/D536E | 107 | 262 |
| V151 | K24A/Q38A/K58A/V60I/K88A/Y93H/N97D/R98K/K125A/K173A/K184R/F209I/M212R/N214D/H219D/Y221V/E238D/K252A/Q282A/Q292K/Q321A/E333D/A345T/N347S/N369I/S377Y/T405R/N429G/A436S/T501P/D536E | 108 | 263 |
| V152 | K24A/Q38A/K58A/V60I/K88A/Y93H/N97D/R98K/K125A/K173A/K184R/F209I/M212R/N214D/H219D/Y221V/E238D/K252A/Q282W/Q292K/Q321A/E333D/A345T/N369I/S377Y/T405R/N429G/A436S/T501P/D536E | 109 | 264 |
| V153 | K24A/Q38A/K58A/V60I/K88A/Y93H/N97D/R98K/K125A/K173A/K184R/F209I/M212R/N214D/H219D/Y221V/E238D/K252A/Q282P/Q292K/Q321A/E333D/A345T/N369I/S377Y/T405R/N429G/A436S/T501P/D536E | 110 | 265 |
| V154 | K24A/Q38A/K58A/V60I/K88A/Y93H/N97D/R98K/K125A/K173A/K184R/F209I/M212R/N214D/H219D/Y221V/E238D/K252A/Q282P/Q292K/Q321A/E333D/A345T/N369I/S377Y/T405R/N429G/A436S/T501P/D536E | 110 | 266 |
| V155 | K24A/Q38A/K58A/V60I/K88A/Y93H/N97D/R98K/K125A/K173A/K184R/F209I/M212R/N214D/H219D/Y221V/E238D/K252A/Q282E/Q292K/Q321A/E333D/A345T/N369I/S377Y/T405R/N429G/A436S/T501P/D536E | 111 | 267 |
| V156 | K24A/Q38A/K58A/V60I/K88A/Y93H/N97D/R98K/K125A/K173A/K184R/F209I/M212R/N214D/H219D/Y221V/E238D/K252A/A284T/Q292K/Y307H/Q321A/E333D/A345T/N369I/S377Y/T405R/N429G/A436S/T501P/D536E | 112 | 268 |
| V157 | K24A/Q38A/K58A/V60I/K88A/Y93H/N97D/R98K/K125A/K173A/K184R/F209I/M212R/N214D/H219D/Y221V/E238D/K252A/A284G/Q292K/Q321A/E333D/A345T/N369I/S377Y/T405R/N429G/A436S/T501P/D536E | 113 | 269 |
| V158 or | K24A/Q38A/K58A/V60I/K88A/Y93H/N97D/R98K/K125A/K173A/K184R/F209I/M212R/N214D/H219D/Y221V/E238D/K252A/A284P/Q292K/Q321A/ | 114 | 270 |

TABLE 3-continued

| Mut No. | Mutation(s) | SEQ ID NO aa | SEQ ID NO nt |
|---|---|---|---|
| V159 | E333D/A345T/N369I/S377Y/T405R/N429G/A436S/T501P/D536E | | |
| V160 | K24A/Q38A/K58A/V60I/K88A/Y93H/N97D/R98K/K125A/K173A/K184R/F209I/M212R/N214D/H219D/Y221V/E238D/K252A/A284G/Q292K/Q321A/E333D/A345T/N369I/S377Y/T405R/N429G/A436S/T501P/D536E | 115 | 272 |
| V161 | K24A/Q38A/K58A/V60I/K88A/Y93H/N97D/R98K/K125A/K173A/K184R/F209I/M212R/N214D/H219D/Y221V/E238D/K252A/A284V/Q292K/Q321A/E333D/A345T/N369I/S377Y/T405R/N429G/A436S/T501P/D536E | 116 | 273 |
| V162 | K24A/Q38A/K58A/V60I/K88A/Y93H/N97D/R98K/K125A/K173A/K184R/F209I/M212R/N214D/H219D/Y221V/E238D/K252A/A284G/Q292K/D301X/Q321A/E333D/A345T/R358X/N369I/S377Y/V378X/T405R/N429G/A436S/T501P/D536E | 117 | 275 |
| V163 | K24A/Q38A/K58A/V60I/K88A/Y93H/N97D/R98K/K125A/K173A/K184R/F209I/M212R/N214D/H219D/Y221V/E238D/K252A/A284R/Q292K/Q321A/E333D/A345T/N369I/S377Y/T405R/N429G/A436S/T501P/D536E | 118 | 276 |
| V164 | K24A/Q38A/K58A/V60I/K88A/Y93H/N97D/R98K/K125A/K173A/K184R/F209I/M212R/N214D/H219D/Y221V/E238D/K252A/A284R/Q292K/Q321A/E333D/A345T/N369I/S377Y/T405R/N429G/A436S/T501P/D536E | 118 | 280 |
| V165 or V166 | K24A/Q38A/K58A/V60I/K88A/Y93H/N97D/R98K/K125A/K173A/K184R/F209I/M212R/N214D/H219D/Y221V/E238D/K252A/A284D/Q292K/Q321A/E333D/A345T/N369I/S377Y/T405R/N429G/A436S/T501P/D536E | 119 | 277 |
| V167 | K24A/Q38A/K58A/V60I/K88A/Y93H/N97D/R98K/K125A/K173A/K184R/F209I/M212R/N214D/H219D/Y221V/E238D/K252A/A284E/Q292K/Q321A/E333D/A345T/N369I/S377Y/T405R/N429G/A436S/T501P/D536E | 120 | 278 |
| V168 | K24A/Q38A/K58A/V60I/K88A/Y93H/N97D/R98K/K125A/K173A/K184R/F209I/M212R/N214D/H219D/Y221V/E238D/K252A/Y283N/A284S/Q292K/Q321A/E333D/A345T/N369I/S377Y/T405R/N429G/A436S/T501P/D536E | 121 | 279 |
| V169 | K24A/Q38A/K58A/V60I/K88A/Y93H/N97D/R98K/K125A/K173A/K184R/F209I/M212R/N214D/H219D/Y221V/E238D/K252A/A284H/Q292K/Q321A/E333D/A345T/N369I/S377Y/T405R/N429G/A436S/T501P/D536E | 122 | 281 |
| V170 | K24A/Q38A/K58A/V60I/K88A/Y93H/N97D/R98K/K125A/K173A/K184R/F209I/M212R/N214D/H219D/Y221V/E238D/K252A/A284K/Q292K/Q321A/E333D/A345T/N369I/S377Y/T405R/N429G/A436S/T501P/D536E | 123 | 282 |
| V171 | K24A/Q38A/K58A/V60I/K88A/Y93H/N97D/R98K/K125A/K173A/K184R/F209I/M212R/N214D/H219D/Y221V/E238D/K252A/A284I/Q292K/Q321A/E333D/A345T/N369I/S377Y/T405R/N429G/A436S/T501P/D536E | 124 | 283 |
| V172 | K24A/Q38A/K58A/V60I/K88A/Y93H/N97D/R98K/K125A/K173A/K184R/F209I/M212R/N214D/H219D/Y221V/E238D/K252A/A284W/Q292K/Q321A/E333D/L342X/A345T/N369I/S377Y/T405R/N429G/A436S/T501P/D536E | 125 | 284 |
| V173 | K24A/Q38A/K58A/V60I/K88A/Y93H/N97D/R98K/K125A/K173A/K184R/F209I/M212R/N214D/H219D/Y221V/E238D/K252A/A284T/Q292K/Q321A/E333D/A345T/N369I/S377Y/T405R/N429G/A436S/T501P/D536E | 126 | 285 |
| V174 | K24A/Q38A/K58A/V60I/K88A/Y93H/N97D/R98K/K125A/K173A/K184R/F209I/M212R/N214D/H219D/Y221V/E238D/K252A/A284M/Q292K/Q321A/W323R/E333D/A345T/N369I/S377Y/T405R/N429G/A436S/T501P/D536E | 127 | 287 |
| V175 | K24A/Q38A/K58A/V60I/K88A/Y93H/N97D/R98K/K125A/K173A/K184R/F209I/M212R/N214D/H219D/Y221V/E238D/K252A/Q292K/Q321A/E333D/A345T/N369I/S377Y/T405R/N429G/A436S/T501P/D536E | 3 | 286 |
| V176 | K24A/Q38A/K58A/V60I/K88A/Y93H/N97D/R98K/K125A/K173A/K184R/F209I/M212R/N214D/H219D/Y221V/E238D/K252A/Q292K/Q321A/E333D/A345T/N369I/S377Y/T405R/N429G/A436S/T501P/D536E | 3 | 288 |
| V177 | K24A/Q38A/K58A/V60I/K88A/Y93H/N97D/R98K/K125A/K173A/K184R/F209I/M212R/N214D/H219D/Y221V/E238D/K252A/Q292K/Q321A/E333D/A345T/N369I/S377Y/T405R/N429G/A436S/T501P/D536E | 3 | 271 |
| V178 | K24A/Q38A/K58A/V60I/K88A/Y93H/N97D/R98K/K125A/K173A/K184R/F209I/M212R/N214D/H219D/Y221V/E238D/K252A/Q282R/Q292K/Q321A/E333D/A345T/N369I/S377Y/T405R/N429G/A436S/T501P/D536E | 103 | 274 |
| V179 | K24Q/Q38N/K58Q/V60I/K88Q/Y93H/N97D/R98K/K125Q/K173Q/K184R/F209I/M212R/N214D/H219D/Y221V/E238D/K252Q/P281S/Q282S/Q292K/E311P/Q321A/E333D/A345T/N369I/S377Y/T405R/N429G/A436S/T501P/D536E | 810 | 754 |
| V180 | K24Q/Q38N/K58Q/V60I/K88Q/Y93H/N97D/R98K/K125Q/K173Q/K184R/F209I/M212R/N214D/H219D/Y221V/E238D/K252Q/P281S/Q282S/Q292K/L310H/E318K/Q321A/E333D/A345T/N369I/S377Y/T405R/N429G/A436S/T501P/D536E | 811 | 755 |
| V181 | K24Q/Q38N/K58Q/V60I/K88Q/Y93H/N97D/R98K/K125Q/K173Q/K184R/F209I/M12R/N214D/H219D/Y221V/E238D/K252Q/P281S/Q282S/Q292K/L310H/Q321A/E333D/A345T/N369I/S377Y/T405R/N429G/A436S/T501P/D536E | 812 | 756 |
| V182 | K24Q/Q38N/K58Q/V60I/K88Q/Y93H/N97D/R98K/K125Q/K173Q/K184R/F209I/M212R/N214D/H219D/Y221V/E238D/K252Q/Q292K/E311P/Q321A/E333D/A345T/N369I/S377Y/T405R/N429G/A436S/T501P/D536E | 723 | 693 |

TABLE 3-continued

| Mut No. | Mutation(s) | SEQ ID NO aa | SEQ ID NO nt |
|---|---|---|---|
| V183 | K24Q/Q38N/K58Q/V60I/K88Q/Y93H/N97D/R98K/K125Q/K173Q/K184R/F209I/M212R/N214D/H219D/Y221V/E238D/K252Q/Q292K/T317S/V320G/Q321A/E333D/A345T/N369I/S377Y/T405R/N429G/A436S/T501P/D536E | 724 | 694 |
| V184 | K24Q/Q38N/K58Q/V60I/K88Q/Y93H/N97D/R98K/K125Q/K173Q/K184R/F209I/M212R/N214D/H219D/Y221V/E238D/K252Q/Q292K/Q321A/E333D/A345T/H360L/N369I/Q370H/A375D/S377Y/T405R/T409G/N429G/A436S/E495G/T501P/D536E | 813 | 757 |
| V185 | K24Q/Q38N/K58Q/V60I/K88Q/Y93H/N97D/R98K/K125Q/K173Q/K184R/F209I/M212R/N214D/H219D/Y221V/E238D/K252Q/Q292K/Q321A/E333D/A345T/N369I/Q370H/A375D/S377Y/T405R/T409G/N429G/A436S/E495G/T501P/D536E | 830 | 717 |
| V186 | S2P/S3R/G4R/E5D/T6R/F7A/K24Q/Q38N/K58Q/V60I/K88Q/Y93H/N97D/R98K/K125Q/K173Q/K184R/F209I/M212R/N214D/H219D/Y221V/E238D/K252Q/Q292K/Q321A/E333D/A345T/N369I/S377Y/T405R/N429G/A436S/T501P/D536E | 814 | 758 |
| V187 | S3L/G4S/E5H/T6D/F7S/K24Q/Q38N/K58Q/V60I/K88Q/Y93H/N97D/R98K/K125Q/K173Q/K184R/F209I/M212R/N214D/H219D/Y221V/E238D/K252Q/Q292K/Q321A/E333D/A345T/N369I/S377Y/T405R/N429G/A436S/T501P/D536E | 815 | 759 |
| V188 | S2T/S3R/E5I/T6L/F7K/K24Q/Q38N/K58Q/V60I/K88Q/Y93H/N97D/R98K/K125Q/K173Q/K184R/F209I/M212R/N214D/H219D/Y221V/E238D/K252Q/Q292K/Q321A/E333D/A345T/N369I/S377Y/T405R/N429G/A436S/T501P/D536E | 816 | 760 |
| V189 | S2L/S3D/G4S/E5I/T6A/F7G/K24Q/Q38N/K58Q/V60I/K88Q/Y93H/N97D/R98K/K125Q/K173Q/K184R/F209I/M212R/N214D/H219D/Y221V/E238D/K252Q/Q292K/Q321A/E333D/A345T/N369I/S377Y/T405R/N429G/A436S/T501P/D536E | 817 | 761 |
| V190 | S2H/S3E/G4P/E5S/T6E/F7T/K24Q/Q38N/K58Q/V60I/K88Q/Y93H/N97D/R98K/K125Q/K173Q/K184R/F209I/M212R/N214D/H219D/Y221V/E238D/K252Q/Q292K/Q321A/E333D/A345T/N369I/S377Y/T405R/N429G/A436S/T501P/D536E | 818 | 762 |
| V191 | S2L/S3G/G4V/E5S/T6E/F7Q/K24Q/Q38N/K58Q/V60I/K88Q/Y93H/N97D/R98K/K125Q/K173Q/K184R/F209I/M212R/N214D/H219D/Y221V/E238D/K252Q/Q292K/Q321A/E333D/A345T/N369I/S377Y/T405R/N429G/A436S/T501P/D536E | 819 | 763 |
| V192 | S2R/S3V/G4A/E5P/T6K/K24Q/Q38N/K58Q/V60I/K88Q/Y93H/N97D/R98K/K125Q/K173Q/K184R/F209I/M212R/N214D/H219D/Y221V/E238D/K252Q/Q292K/Q321A/E333D/A345T/N369I/S377Y/T405R/N429G/A436S/T501P/D536E | 820 | 764 |
| V193 | S2R/S3A/G4E/E5L/T6S/F7L/K24Q/Q38N/K58Q/V60I/K88Q/Y93H/N97D/R98K/K125Q/K173Q/K184R/F209I/M212R/N214D/H219D/Y221V/E238D/K252Q/Q292K/Q321A/E333D/A345T/N369I/S377Y/T405R/N429G/A436S/T501P/D536E | 821 | 765 |
| V194 | S2Q/G4I/E5T/T6D/F7K/K24Q/Q38N/K58Q/V60I/K88Q/Y93H/N97D/R98K/K125Q/K173Q/K184R/F209I/M212R/N214D/H219D/Y221V/E238D/K252Q/Q292K/Q321A/E333D/A345T/N369I/S377Y/T405R/N429G/A436S/T501P/D536E | 725 | 695 |
| V195 | S2R/S3V/G4I/E5D/T6G/F7G/K24Q/Q38N/K58Q/V60I/K88Q/Y93H/N97D/R98K/K125Q/K173Q/K184R/F209I/M212R/N214D/H219D/Y221V/E238D/K252Q/Q292K/Q321A/E333D/A345T/N369I/S377Y/T405R/N429G/A436S/T501P/D536E | 822 | 766 |
| V196 | K24Q/Q38N/K58Q/V60I/K88Q/Y93H/N97D/R98K/L106A/K125Q/K173Q/K184R/F209I/M212R/N214D/H219D/Y221V/E238D/K252Q/Q292K/Q321A/E333D/A345T/N369I/S377Y/T405R/N429G/A436S/T501P/D536E | 726 | 696 |
| V197 | K24Q/Q38N/K58Q/V60I/K88Q/Y93H/N97D/R98K/L106S/K125Q/K173Q/K184R/F209I/M212R/N214D/H219D/Y221V/E238D/K252Q/Q292K/Q321A/E333D/A345T/N369I/S377Y/T405R/N429G/A436S/T501P/D536E | 727 | 697 |
| V198 | K24Q/Q38N/K58Q/V60I/K88Q/Y93H/N97D/R98K/L106K/K125Q/K173Q/K184R/F209I/M212R/N214D/H219D/Y221V/E238D/K252Q/Q292K/Q321A/E333D/A345T/N369I/S377Y/T405R/N429G/A436S/T501P/D536E | 728 | 698 |
| V199 | K24Q/Q38N/T53L/D54A/A55P/E56P/D57P/K58R/V60I/K88Q/Y93H/N97D/R98K/K125Q/K173Q/K184R/F209I/M212R/N214D/H219D/Y221V/E238D/K252Q/Q292K/Q321A/E333D/A345T/N369I/S377Y/T405R/N429G/A436S/T501P/D536E | 823 | 767 |
| V200 | K24Q/Q38N/K58Q/V60I/K88Q/Y93H/N97D/R98K/K125Q/M153N/K173Q/K184R/F209I/M212R/N214D/H219D/Y221V/E238D/K252Q/Q292K/Q321A/E333D/A345T/N369I/S377Y/T405R/N429G/A436S/K474T/T501P/D536E | 729 | 699 |
| V201 | K24Q/Q38N/K58Q/V60I/K88Q/Y93H/N97D/R98K/K125Q/K173Q/K184R/F209I/M212R/I213S/N214D/H219D/Y221V/E238D/K252Q/Q292K/Q321A/E333D/A345T/N369I/S377Y/T405R/N429G/A436S/T501P/D536E | 824 | 768 |
| V202 | K24Q/Q38N/K58Q/V60I/K88Q/Y93H/N97D/R98K/K125Q/K173Q/K184R/F209I/M212R/N214D/H219A/Y221V/E238D/K252Q/Q292K/Q321A/E333D/A345T/N369I/S377Y/T405R/N429G/A436S/T501P/D536E | 730 | 700 |

TABLE 3-continued

| Mut No. | Mutation(s) | SEQ ID NO aa | SEQ ID NO nt |
|---|---|---|---|
| V203 | K24Q/Q38N/K58Q/V60I/K88Q/Y93H/N97D/R98K/K125Q/K173Q/K184R/Q188R/I189V/P202S/F209I/M212R/N214D/H219D/Y221V/E238D/K252Q/Q292K/Q321A/E333D/A345T/N369I/S377Y/T405R/N429G/A436S/T501P/D536E | 825 | 769 |
| V204 | K24Q/Q38N/K58Q/V60I/K88Q/Y93H/N97D/R98K/K125Q/M153N/K173Q/K184R/F209I/M212R/N214D/H219D/Y221V/E238D/K252Q/Q292K/Q321A/E333D/A345T/N369I/S377Y/T405R/N429G/A436S/K474T/T501P/D536E | 826 | 770 |
| V205 | K24Q/Q38N/K58Q/V60I/K88Q/Y93H/N97D/R98K/K125Q/H159R/K173Q/K184R/F209I/M212R/N214D/H219D/Y221V/E238D/K252Q/Q292K/Q321A/E333D/A345T/N369I/S377Y/T405R/N429G/A436S/T501P/D536E | 827 | 771 |
| V206 | K24Q/Q38N/K58Q/V60I/K88Q/Y93H/N97D/R98K/K125Q/H159K/K173Q/K184R/F209I/M212R/N214D/H219D/Y221V/E238D/K252Q/Q292K/Q321A/E333D/A345T/N369I/S377Y/T405R/N429G/A436S/T501P/D536E | 828 | 772 |
| V207 | K24Q/Q38N/K58Q/V60I/K88Q/Y93H/N97D/R98K/K125Q/K173Q/K184R/I189P/F209I/M212R/N214D/H219D/Y221V/E238D/K252Q/Q292K/Q321A/E333D/A345T/N369I/S377Y/T405R/N429G/A436S/T501P/D536E | 829 | 773 |
| V208 | K24Q/Q38N/T53L/D54P/A55R/E56F/D57S/K58Q/V60I/K88Q/Y93H/N97D/R98K/K125Q/K173Q/K184R/F209I/M212R/N214D/H219D/Y221V/E238D/K252Q/Q292K/Q321A/E333D/A345T/N369I/S377Y/T405R/N429G/A436S/T501P/D536E | 731 | 701 |
| V209 | K24Q/Q38N/D54A/A55V/E56A/D57Q/K58P/V60I/K88Q/Y93H/N97D/R98K/L106F/K125Q/K173Q/K184R/F209I/M212R/N214D/H219D/Y221V/E238D/K252Q/Q292K/Q321A/E333D/A345T/N369I/S377Y/T405R/N429G/A436S/T501P/D536E | 734 | 704 |
| V210 | K24Q/Q38N/T53R/D54A/A55Q/E56T/D57A/K58R/V60I/K88Q/Y93H/N97D/R98K/K125Q/K173Q/K184R/F209I/M212R/N214D/H219D/Y221V/E238D/K252Q/Q292K/Q321A/E333D/A345T/N369I/S377Y/T405R/N429G/A436S/T501P/D536E | 735 | 705 |
| V211 | K24Q/Q38N/T53R/D54C/A55V/E56Q/D57P/K58E/V60I/K88Q/Y93H/N97D/R98K/K125Q/K173Q/K184R/F209I/M212R/N214D/H219D/Y221V/E238D/K252Q/Q292K/Q321A/E333D/A345T/N369I/S377Y/T405R/N429G/A436S/T501P/D536E | 736 | 706 |
| V212 | K24Q/Q38N/K58Q/V60I/K88Q/Y93H/N97D/R98K/K125Q/R132G/K173Q/K184R/F209I/M212R/N214D/H219D/Y221V/E238D/K252Q/Q292K/Q321A/E333D/A345T/N369I/S377Y/T405R/N429G/A436S/T501P/D536E | 737 | 707 |
| V213 | K24Q/Q38N/K58Q/V60I/K88Q/Y93H/N97D/R98K/K125Q/H159Q/K173Q/K184R/F209I/M212R/N214D/H219D/Y221V/E238D/K252Q/Q292K/Q321A/E333D/A345T/N369I/S377Y/T405R/N429G/A436S/T501P/D536E | 738 | 708 |
| V214 | K24Q/Q38N/K58Q/V60I/K88Q/Y93H/N97D/R98K/K125Q/M153G/K173Q/K184R/F209I/M212R/N214D/H219D/Y221V/E238D/K252Q/Q292K/Q321A/E333D/A345T/N369I/S377Y/T405R/N429G/A436S/T501P/D536E | 739 | 709 |
| V215 | K24Q/Q38N/K58Q/V60I/K88Q/Y93H/N97D/R98K/K125Q/K173Q/K184R/F209I/M212R/N214D/H219D/Y221V/E238D/K252Q/Q292K/Q321A/E333D/A345T/N369I/S377Y/I397V/T405R/N429G/A436S/T501P/D536E | 740 | 710 |
| V216 | K24Q/Q38N/K58Q/V60I/K88Q/Y93H/N97D/R98K/K125Q/K173Q/K184R/F209I/M212R/N214D/H219D/Y221V/E238D/K252Q/Q292K/Q321A/E333D/A345T/N369I/S377Y/T405R/N429G/A436S/T501P/D536E | 4 or 741 | 711 |
| V217 | K24Q/Q38N/K58Q/V60I/K88Q/Y93H/N97D/R98K/K125Q/K173Q/K184R/I189A/F209I/M212R/N214D/H219D/Y221V/E238D/K252Q/Q292K/Q321A/E333D/A345T/N369I/S377Y/T405R/N429G/A436S/T501P/D536E | 742 | 712 |
| V218 and V219 | K24Q/Q38N/K58Q/V60I/K88Q/Y93H/N97D/R98K/K125Q/K173Q/K184R/F209I/M212R/N214D/H219D/Y221V/E238D/K252Q/Q292K/L310H/E311P/Q321A/E333D/A345T/N369I/S377Y/T405R/N429G/A436S/T501P/D536E | 746 | 716 |
| V220 | K24Q/Q38N/K58Q/V60I/K88Q/Y93H/N97D/R98K/K125Q/K173Q/K184R/F209I/M212N/I213Y/N214L/S215R/T216R/S217I/D218P/H219A/L220D/Y221S/E238D/K252Q/P281S/Q292K/L313C/S314T/L315M/T317S/Q321A/E333D/K336R/L337I/A345T/G357R/N369I/S377Y/T405R/N429G/A436S/T501P/D536E | 747 | 718 |
| V221 | K24Q/Q38N/K58Q/V60I/K88Q/Y93H/N97D/R98K/Q113R/K125Q/K173Q/K184R/F209I/M212D/I213Y/N214E/S215H/T216Q/D218I/H219L/L220V/Y221Q/E238D/K252Q/P281S/Q292K/L313C/S314T/L315M/T317S/Q321A/E333D/K336R/L337I/A345T/G357R/N369I/S377Y/T405R/N429G/A436S/T501P/D536E | 748 | 719 |
| V222 | K24Q/Q38N/K58Q/V60I/K88Q/Y93H/N97D/R98K/K125Q/K173Q/K184R/F209I/M212S/I213L/N214E/S215P/T216P/S217F/D218M/L220P/Y221C/E238D/K252Q/Q292K/L313C/S314T/L315M/T317S/Q321A/E333D/K336R/L337I/A345T/G357R/N369I/S377Y/T405R/N429G/A436S/T501P/D536E | 831 | 774 |
| V223 | K24Q/Q38N/K58Q/V60I/K88Q/Y93H/N97D/R98K/K125Q/K173Q/K184R/F209I/M212A/N214Y/S215A/T216R/S217T/D218G/H219R/L220M/Y221N/E238D/K252Q/Q292K/L313C/S314T/L315M/T317S/Q321A/E333D/K336R/L337I/A345T/G357R/N369I/S377Y/T405R/N429G/A436S/T501P/D536E | 832 | 775 |

TABLE 3-continued

| Mut No. | Mutation(s) | SEQ ID NO aa | nt |
|---|---|---|---|
| V224 | K24Q/Q38N/K58Q/V60I/K88Q/Y93H/N97D/R98K/K125Q/K173Q/K184R/F209I/M212N/I213M/N214S/T216Y/S217R/D218G/H219C/L220S/Y221V/E238D/K252Q/P281S/Q292K/L313C/S314T/L315M/T317S/A319T/Q321A/E333D/K336R/L337I/A345T/N369I/S377Y/T405R/N429G/A436S/T501P/D536E | 749 | 720 |
| V225 | K24Q/Q38N/K58Q/V60I/K88Q/Y93H/N97D/R98K/K125Q/K173Q/K184R/F209I/M212D/I213A/S215G/T216E/S217K/D218V/H219L/L220S/Y221F/E238D/K252Q/P281S/Q292K/L313C/S314T/L315M/T317S/Q321A/E333D/K336R/L337I/A345T/G357R/N369I/S377Y/T405R/N429G/A436S/T501P/D536E | 750 | 721 |
| V226 | K24Q/Q38N/K58Q/V60I/K88Q/Y93H/N97D/R98K/K125Q/K173Q/K184R/F209I/M212S/I213R/N214S/S215K/T216P/S217F/D218C/H219W/L220T/Y221S/E238D/K252Q/Q292K/Q321A/E333D/A345T/N369I/S377Y/T405R/N429G/A436S/T501P/D536E | 751 | 722 |
| V227 | K24Q/Q38N/K58Q/V60I/K88Q/Y93H/N97D/R98K/K125Q/K173Q/K184R/F209H/M212R/N214D/H219D/Y221V/E238D/K252Q/P281S/Q292K/L313C/S314T/L315M/T317S/Q321A/E333D/K336R/L337I/A345T/G357R/N369I/S377Y/T405R/N429G/A436S/T501P/D536E | 857 | 800 |

2. Domain Swaps

Provided herein are modified terpene synthase polypeptides, in particular modified valencene synthase polypeptides, that are chimeric polypeptides containing a swap (deletion and insertion) by deletion of amino acid residues of one of more domains or regions therein or portions thereof and insertion of a heterologous sequence of amino acids. In some examples, the heterologous sequence is a randomized sequence of amino acids. In other examples, the heterologous sequence is a contiguous sequence of amino acids for the corresponding domain or region or portion thereof from another terepene synthase polypeptide. The heterologous sequence that is replaced or inserted generally includes at least 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, or more amino acids. In examples where the heterologous sequence is from a corresponding domain or a portion thereof of another terpene synthase, the heterologous sequence generally includes at least 50%, 60%, 70%, 80%, 90%, 95% or more contiguous amino acids of the corresponding domain or region or portion. In such an example, adjacent residues to the heterologous corresponding domain or region or portion thereof also can be included in a modified valencene polypeptide provided herein.

In one example of swap mutants provided herein, at least one domain or region or portion thereof of a valencene synthase polypeptide is replaced with a contiguous sequence of amino acids for the corresponding domain or region or portions thereof from another terpene synthase polypeptide. In some examples, 2, 3, 4, 5, 6, 7, 8, 9, 10 or more domains or regions or portions thereof are replaced with a contiguous sequence of amino acids for the corresponding domain or region or portions thereof from another terepene synthase polypeptide.

Any domain or region or portion thereof of a valencene synthase polypeptide can be replaced with a heterologous sequence of amino acids, such as heterologous sequence from the corresponding domain or region from another terpene. A domain or region can be a structural domain or a functional domain. One of skill in the art is familiar with domains or regions in terpene synthases. Functional domains include, for example, the catalytic domain or a portion thereof. Functional domains also can include functional domains identified as being associated with substrate specificity and product distributions, such as for example, the Aristolochene specific domain, the ratio determinant domain, the Vestispiradiene specific domain, the substrate binding domain or the *Hyoscyamus* specific domain or other similar domains in other synthases (see e.g. U.S. Pat. No. 5,824,774). A structural domain can include all or a portion of unstructured loop 1; alpha helix 1; unstructured loop 2; alpha helix 2; unstructured loop 3; alpha helix 3; unstructured loop 4; alpha helix 4; unstructured loop 5; alpha helix 5; unstructured loop 6; alpha helix 6; unstructured loop 7; alpha helix 7; unstructured loop 8; alpha helix 8; unstructured loop 9; alpha helix A; A-C loop; alpha helix C; unstructured loop 11; alpha helix D; unstructured loop 12; alpha helix D1; unstructured loop; alpha helix D2; unstructured loop 14; alpha helix E; unstructured loop 15; alpha helix F; unstructured loop 16; alpha helix G1; unstructured loop 17; alpha helix G2; unstructured loop 18; alpha helix H1; unstructured loop 19; alpha helix H2; unstructured loop 20; alpha helix H3; unstructured loop 21; alpha helix a-1; unstructured loop 22; alpha helix I; unstructured loop 23; alpha helix J; J-K loop; alpha helix K and/or unstructured loop 25 (see e.g. FIGS. 2A-C).

One of skill in the art is familiar with various terpene synthases and can identify corresponding domains or regions or portions of amino acids thereof. Table 5B below sets forth the sequence of exemplary terpene synthases. In particular examples herein, modified valencene synthase polypeptide domain swap mutants provided herein contain heterologous sequence from a corresponding domain or region or portion thereof of a terpene synthase polypeptide that is a *Vitis vinifera* valencene synthase (SEQ ID NOS:346 and 347), tobacco 5-epi-aristolochene synthase (TEAS; SEQ ID NO:295 or 941) or *Hyoscyamus muticus* premnaspirodiene synthase (HPS; SEQ ID NO:296 or 942).

Typically, the resulting modified valencene synthase exhibits valencene synthase activity and the ability to produce valencene from FPP. For example, the modified valencene synthase polypeptides exhibit 50% to 5000%, such as 50% to 120%, 100% to 500% or 110% to 250% of the valencene production from FPP compared to the valencene synthase polypeptide not containing the modification (e.g. the amino acid replacement or swap of amino acid residues of a domain or region) and/or compared to wild-type valencene synthase polypeptide set forth in SEQ ID NO:2. Typically, as demonstrated in the Examples herein, the modified valencene polypeptides exhibit increased valencene production from FPP compared to the valencene synthase polypeptide not containing the modification, such as compared to wild-type valencene synthase set forth in SEQ ID NO:2. For example, the modified valencene synthase polypeptides can produce valencene from FPP in an amount that is at least or about 101%, 102%, 103%, 104%, 105%, 106%, 107%, 108%, 109%, 110%, 115%, 120%, 125%, 130%, 135%, 140%, 145%, 150%, 160%, 170%, 180%, 200%, 250%, 300%, 350%, 400%, 500%, 1500%, 2000%, 3000%, 4000%, 5000% of the amount of valencene produced from FPP by wild-type valencene synthase not containing the modification under the same conditions. For example, the valence production is increased at least 1.2-fold, 1.5-fold, 2-fold, 3-fold, 4-fold, 5-fold, 6-fold, 7-fold, 8-fold, 9-fold, 10-fold, 11-fold, 12-fold, 13-fold, 14-fold, 15-fold, 16-fold, 17-fold, 18-fold, 19-fold, 20-fold or more.

In particular examples herein, modified valencene synthase polypeptides provided herein are swap mutants whereby all or a portion of one or more structural domains is replaced with a corresponding structural domain of another terpene polypeptide. Table 4A below identifies structural domains with numbering based on TEAS numbering or CVS numbering, which are common numbering schemes for all terpene synthases based on alignment of the synthase with TEAS or CVS, respectively (see e.g. FIGS. 4A-D). Hence, the corresponding domain can be identified in other terpene synthases. FIG. 2 FIGS. 2A-C herein further depict the structural domains and regions in exemplary terpene synthases, and the corresponding amino acid residues of each.

TABLE 4A

| Structural Domains | | |
|---|---|---|
| Structural Domain | TEAS numbering | CVS numbering |
| unstructured loop 1 | 1-35 | 1-29 |
| alpha helix 1 | 36-57 | 30-39, 44-52 |
| unstructured loop 2 | 58-63 | 53-58 |
| alpha helix 2 | 64-76 | 59-71 |
| unstructured loop 3 | 77-83 | 72-78 |
| alpha helix 3 | 84-96 | 79-83 (residues 84-93 are not alpha helical) |
| unstructured loop 4 | 197-103 | 94-100 |
| alpha helix 4; | 104-117 | 101-114 |
| unstructured loop 5 | 118-144 | 115-141 |
| alpha helix 5 | 145-155 | 142-152 |
| unstructured loop 6 | 156-165 | 153-162 |
| alpha helix 6 | 166-179 | 163-173 |
| unstructured loop 7 | 180-185 | 174-184 |
| alpha helix 7 | 186-195 | 185-194 |
| unstructured loop 8 | 196-202 | 195-201 |
| alpha helix 8 | 203-213 | 202-212 |
| unstructured loop 9 | 214-222 | 213-222 |
| alpha helix A | 223-253 | 223-253 |
| A-C loop | 254-266 | 254-266 |
| alpha helix C | 267-276 | 267-276 |
| unstructured loop 11 | 277-283 | 277-283 |
| alpha helix D | 284-305 | 284-305 |
| unstructured loop 12 | 306-309 | 306-309 |
| alpha helix D1 | 310-322 | 310-322 |
| unstructured loop 13 | 323-328 | 323-328 |
| alpha helix D2 | 329 | 329 |
| unstructured loop 14 | 330-332 | 330-332 |
| alpha helix E | 333-351 | 333-351 |
| unstructured loop 15 | 352-362 | 352-362 |
| alpha helix F | 363-385 | 363-385 |
| unstructured loop 16 | 386-390 | 386-390 |
| alpha helix G1 | 391-395 | 391-395 |
| unstructured loop 17 | 396-404 | 396-404 |
| alpha helix G2 | 405-413 | 405-413 |
| unstructured loop 18 | 414-420 | 414-421 |
| alpha helix H1 | 421-427 | 422-428 |
| unstructured loop 19 | 428-430 | 429-431 |
| alpha helix H2 | 431-446 | 432-447 |
| unstructured loop 20 | 447-449 | 448-450 |
| alpha helix H3 | 450-454 | 451-455 |
| unstructured loop 21 | 455-460 | 456-461 |
| alpha helix a-1 | 461-469 | 462-470 |
| unstructured loop 22 | 470-472 | 471-473 |
| alpha helix I | 473-494 | 474-495 |
| unstructured loop 23 | 495-506 | 496-508 |
| alpha helix J | 507-519 | 509-521 |
| J-K loop | 520-530 | 522-534 |
| alpha helix K | 531-541 | 535-541 |
| unstructured loop 25 | 542-548 | 542-548 |

Table 4B sets forth exemplary structural domain or domains or portions thereof that are replaced in a modified valencene synthase polypeptide provided herein, and also identifies exemplary corresponding replacement residues from other terpene synthases. Any of the below domains or regions or portions thereof in a valencene synthase can be replaced with the corresponding region from another terpene synthase, including, but not limited to *Vitis vinifera* valencene synthase (SEQ ID NOS:346 and 347), TEAS (SEQ ID NO:295 and 941) or HPS (SEQ ID NO:296 and 942).

TABLE 4B

| Exemplary Domain(s) or portions | | | | |
|---|---|---|---|---|
| | Replaced Amino Acids in Valencene | Replacing Amino Acids | | |
| Domains(s) or portions | Synthase CVS numbering | TEAS (SEQ ID NO: 295 or 941) | HPS (SEQ ID NO: 942) | *Vitis vinifera* (SEQ IDNO: 346) |
| unstructured loop 1 and alpha helix 1 | 3-41 | | | 3-51 |
| unstructured loop 2 | 53-58 | 58-63 | 60-65 | 63-69 |
| alpha helix 3 | 85-89 | 90-94 | 93-97 | 96-100 |
| alpha helix 3 and unstructured loop 4 | 85-99 | 90-102 | 93-110 | 96-112 |
| unstructured loop 5 and adjacent residues | 115-146 | | | 128-159 |

TABLE 4B-continued

| Exemplary Domain(s) or portions | | | | |
|---|---|---|---|---|
| | Replaced Amino Acids in Valencene | Replacing Amino Acids | | |
| Domains(s) or portions | Synthase CVS numbering | TEAS (SEQ ID NO: 295 or 941) | HPS (SEQ ID NO: 942) | *Vitis vinifera* (SEQ IDNO: 346) |
| unstructured loop 6 and adjacent residues | 152-163 | 155-166 | 163-174 | 165-176 |
| unstructured loop 7 | 174-184 | 177-185 | 185-193 | 187-195 |
| unstructured loop 9 and adjacent residue | 212-221 | 213-221 | 221-228 | 223-230 |
| alpha helix D1 | 310-322 | 310-322 | 317-329 | 319-331 |
| J-K loop | 522-534 | 520-534 | 527-541 | 530-543 |

For example, in modified valencene polypeptides provided herein one or more of a portion of unstructured loop 1 and alpha helix 1 of valencene synthase (corresponding to amino acids 3-41 of SEQ ID NO:2) can be replaced with the corresponding region from *Vitis vinifera* (corresponding to amino acids 3-51 of SEQ ID NO:346); unstructured loop 2 of valencene synthase (corresponding to amino acids 53-58 of SEQ ID NO:2) can be replaced with the corresponding region from TEAS (corresponding to amino acids 58-63 of SEQ ID NO:295 or 941); a portion of alpha helix 3 (corresponding to amino acids 85-89 of SEQ ID NO:2) is replaced with amino acid residues 93-97 of HPS (SEQ ID NO:942); a portion of alpha helix 3 and unstructured loop 4 (corresponding to amino acids 85-99 of SEQ ID NO:2) is replaced with amino acid residues 93-110 of HPS (SEQ ID NO: 942); unstructured loop 5 and adjacent residues of valencene synthase (corresponding to amino acids 115-146 of SEQ ID NO:2) is replaced with the corresponding region from *Vitis vinifera* (corresponding to amino acids 128-159 of SEQ ID NO:346); unstructured loop 6 and adjacent residues (corresponding to amino acids 152-163 of SEQ ID NO:2) is replaced with the corresponding region from HPS (corresponding to amino acids 163-174 of SEQ ID NO: 942); unstructured loop 7 (corresponding to amino acids 174-184 of SEQ ID NO:2) is replaced with the corresponding region from HPS (corresponding to amino acids 185-193 of SEQ ID NO: 942); unstructured loop 9 and an adjacent residue (corresponding to amino acids 212-221 of SEQ ID NO:2) is replaced with the corresponding region from HPS (corresponding to amino acids 221-228 of SEQ ID NO: 942); alpha helix D1 (corresponding to amino acids 310-322 of SEQ ID NO:2) is replaced with the corresponding region from HPS (corresponding to amino acids 317-329 of SEQ ID NO: 942); and/or the J-K loop (corresponding to amino acids 522-534 of SEQ ID NO:2) is replaced with the corresponding region from HPS (corresponding to amino acids 527-541 of SEQ ID NO: 942). The resulting modifications can be amino acid insertions, deletions or amino acid replacements. For example, exemplary amino acid replacements include, but are not limited to, S3T, G4Q, E5V, T6K, F7N, T10V, D12N, S16N, L17I, R19G, N20D, H21Q, L23I, K24T, G25Y, A26T, S27P, D28E, F29D, D33T, H34R, T35A, A36C, T37K, Q38E, R40Q, H41I, T53L, D54A, A55T, E56G, D57R, A85M, I86L, Q87D, K88H, L89I, C90Y, P91N, I92Y, I92N, I92S, Y93F, Y93F, I94E, I94H, D95A, S96H, S96C, N97E, R98Y, R98D, A99N, A99M, I116Y, K117T, V122I, E124N, K127T, D129E, E130R, S135E, S136A, N139S, Q142R, S146G, Q178A, D179P, V181L, T182K, P183S, K184P, M212I, M212S, M212V, I213Y, N214Y, N214Q, S215D, T216K, S217E, S217D, D218E, H219G, H219Q, H219A, L220F, Y221K or Y221H by CVS numbering with reference to positions set forth in SEQ ID NO:2.

Exemplary swap modifications, i.e. deletion of a domain or region in a valencene synthase and insertion of heterologous amino acid of the corresponding domain or region from another terpene synthase, are set forth in Table 4C. The replaced (deleted) amino acids corresponding to residues in valencene synthase set forth in SEQ ID NO:2 are indicated, as well as the inserted amino acids from the corresponding domain or region of the other terpene synthase. It is understood that while this Table references amino acid positions of a valencene synthase by CVS numbering set forth in SEQ ID NO:2, similar swaps can be made in other valencene synthases, and in particular in other citrus-derived valencene synthases, by identification of corresponding amino acid residues and regions (see e.g. FIGS. 1A-D and FIGS. 2A-C). Thus, such modifications can be made in a wild-type valencene synthase, such as any set forth in SEQ ID NOS: 2, 289-291, 346, 347, 752, 882 or 883 or any variant thereof. For example, swaps can be made in any valencene synthase polypeptide set forth in Table 3 above. For example, the domain substitutions described above can be made to any of the modified valencene synthase polypeptides set forth in SEQ ID NOS:3-66, 68-127, 348, 723-731, 734-742, 746-751, 810-832 or 857. In one example, the domain substitutions described above are made to the modified synthase set forth in SEQ ID NO:4.

TABLE 4C

| SWAP MODIFICATIONS | | | | |
|---|---|---|---|---|
| Modification | Replaced Amino Acids | SEQ ID NO | Inserted Amino Acids | SEQ ID NO |
| CVS3-41swapVITIS3-51 | SGETFRPTADFHPSLW RNHFLKGASDFKTVDH TATQERH | 867 | TQVSASSLAQIPQPKNRP VANFHPNIWGDQFITYTP EDKVTRACKEEQI | 872 |

TABLE 4C-continued

| SWAP MODIFICATIONS | | | | |
|---|---|---|---|---|
| Modification | Replaced Amino Acids | SEQ ID NO | Inserted Amino Acids | SEQ ID NO |
| CVS53-58swapTEAS58-63 | TDAEDK | 868 | LATGRK | 873 |
| CVS85-99swapHPS 93-110 | AIQKLCPIYIDSNRA | 869 | MLDHIYRADPYFEAHEYN | 874 |
| CVS85-99swapVITIS96-112 | AIQKLCPIYIDSNRA | 869 | ALQHICNSFHDCNDMDG | 875 |
| CVS115-146swapVITIS128-159 | GIKISCDVFEKFKDDE GRFKSSLINDVQGMLS | 1000 | GYTISCDIFNKFTDERGR FKEALISDVRGMLG | 1001 |
| CVS174-184swap HPS185-193 | SLVAQDHVTPK | 870 | SAAPHLKSP | 877 |
| CVS212-221swap HPS221-228 | MINSTSDHLY | 871 | IYEEEEFK | 878 |
| CVS212-221swap HPS221-228 with E226G | MINSTSDHLY | 871 | IYEEEGFK | 879 |
| CVS212-221swap TEAS213-221 | MINSTSDHLY | 871 | SIYDKEQSK | 880 |
| CVS212-221swap VITIS223-230 | MINSTSDHLY | 871 | VYQDEAFH | 881 |

Any methods known in the art for generating chimeric polypeptides can be used to replace all or a contiguous portion of a domain or a first terpene synthase with all or a contiguous portion of the corresponding domain of a second synthase. For example, corresponding domains or regions of any two terpene synthases can be exchanged using any suitable recombinant method known in the art, or by in vitro synthesis. Exemplary of recombinant methods is a two stage overlapping PCR method, such as described in Example 3.D. In such methods, primers that introduce mutations at a plurality of codon positions in the nucleic acids encoding the targeted domain or portion thereof in the first terpene synthase can be employed, wherein the mutations together form the heterologous region (i.e. the corresponding region from the second terpene synthase). Alternatively, for example, randomized amino acids can be used to replace specific domains or regions. It is understood that primer errors, PCR errors and/or other errors in the cloning or recombinant methods can result in errors such that the resulting swapped or replaced region or domain does not exhibit an amino acid sequence that is identical to the corresponding region from the second terpene synthase.

In an exemplary PCR-based method, the first stage PCR uses (i) a downstream primer that anneals downstream of the region that is being replaced (e.g. primer 7-10.4, described in Example 5; SEQ ID NO:339), with a mutagenic primer that includes approximately fifteen nucleotides (or an effective number to effect annealing, such as 5, 6, 7, 8, 9, 10, 11, 12, 13, 14, 15, 16, 17, 20, 25 nucleotides or more) of homologous sequence on each side of the domain or region to be exchanged or randomized flanking the region to be imported into the target gene, and (ii) an upstream primer that anneals upstream of the region that is being replaced (e.g. primer 7-10.3, described in Example 5; SEQ ID NO:338) together with an opposite strand mutagenic primer that also includes approximately fifteen nucleotides (or an effective number to effect annealing, such as 5, 6, 7, 8, 9, 10, 11, 12, 13, 14, 15, 16, 17, 20, 25 nucleotides or more) of homologous sequence on each side of the domain or region to be exchanged or randomized flanking the region to be imported into the target gene. If a replacement in which a domain or region of a first terpene synthase gene is replaced with the corresponding domain or region from a second terpene synthase is being performed, nucleotides in the mutagenic primers between the flanking regions from the first terpene synthase contain codons for the corresponding region of the second terpene synthase. In instances where the amino acids in a domain or region are to be randomized, nucleotides of the mutagenic primers between the flanking regions from the first terpene synthase contains random nucleotides. An overlapping PCR is then performed to join the two fragments, using the upstream and downstream oligo (e.g. primers 7-10.3 and 7-10.4). The resulting PCR product can then be cloned into any suitable vector for expression of the modified terpene synthase.

Further, any of the modified valencene synthase polypeptides containing swap mutations herein can contain one or more further amino acid replacements. Exemplary amino acid substitutions (or replacements) that can be included in the modified valencene synthase polypeptides provided include, but are not limited to, M1T, S2R, S2K, S2E, S2Q, S2P, S2T, S2L, S2H, S2A, S2V, S3D, S3R, S3G, S3I, S3E, S3V, S3A, S3T, S3L, S3M, S3N, G4K, G4V, G4N, G4I, G4R, G4S, G4P, G4A, G4E, G4F, G4C, G4T, G4L, E5A, E5G, E5S, E5T, E5D, E5H, E5I, E5P, E5L, E5N, T6R, T6V, T6D, T6L, T6A, T6E, T6K, T6S, T6G, T6C, T6M, T6Y, F7C, F7A, F7Q, F7K, F7S, F7G, F7T, F7L, F7R, F7P, A11T, R19K, R19P, N20D, L23S, K24A, K24Q, K24Y, D28G, Q38V, Q38A, Q38N, R50G, T53L, T53R, D54A, D54P, D54C, A55T, A55P, A55R, A55V, A55Q, E56G, E56P, E56F, E56A, E56T, E56Q, D57R, D57P, D57S, D57Q, D57A, K58Q, K58R, K58P, K58E, K58A, V60I, V60G, K62R, V69I, F78L, I82V, K88Q, K88A, Y93H, N97D, R98K, H102Y, L106A, L106S, L106K, L106F, L111S, Q113R, K125A, K125Q, R132G, Y152H, M153N, M153G, H159Q, H159K, H159R, E163D, K173E, K173Q, K173A, K184R, Q188R, I189A, I189V, I189P, T200Q, P202S, F209I, F209H, F209E, F209L, F209T, M210T, M212R, M212D, M212N, M212S, M212A, M212Y, M212K, M212F, M212H, M212Q, I213Y, I213M, I213A, I213R, I213S, I213L, I213F, I213S, I213P, I213Q, I213N, I213K, I213V, N214D, N214E, N214S, N214L, N214Y, N214V, N214P, N214H, N214C, N214A, N214T, N214R, S215H, S215G, S215K, S215R, S215P, S215A, S215N, S215T, S215L, S215V, S215Q, T216Q, T216Y, T216E, T216P, T216R, T216C, T216V, T216K, T216D, T216A, T216S, S217R, S217K, S217F, S217I, S217T, S217G, S217Y, S217N, S217H, S217E, S217F, S217C, D218I, D218G, D218V, D218C, D218P, D218M, D218R, D218L, D218S, D218A, D218Y, D218K, H219D, H219A, H219L, H219C, H219W, H219R, H219S, H219F, H219E, L220V, L220S, L220T, L220P, L220M, L220A, L220H, L220E, L220G, L220D, Y221C, Y221V, Y221Q, Y221F, Y221S, Y221N, Y221T, Y221P, Y221L, Y221K, Y221W, Y221E, Y221V, N227S, E238D, K252A, K252Q, T257A, D274M, D274N, D274S, D274F, D274G, D274H, D274E, F279S, F279I, F279P, F279D, F279L, F279N, F279M, F279H, F279C, F279A, F279G, F279W, E280L, P281S, P281H, P281K, P281A, P281W, P281L, P281Y, Q282L, Q282S, Q282A, Q282I, Q282R, Q282Y, Q282G, Q282W, Q282P, Q282E, Y283F, Y283N, A284T, A284G, A284P, A284V, A284R, A284D, A284E, A284S, A284H, A284K, A284I, A284W, A284M, Q292K, I299Y, Y307H, L310H, E311P, E311T, L313C, S314A, S314T, L315M, F316L, T317S, E318K, A319T, V320D, V320G, V320S, Q321A, W323R, N324S, I325T, E326K, E333D, K336R, L337I, L343V, A345V, A345T, N347L, N347S, E348A, E348S, E350K, G357R, H360L, H360A, C361R, V362A, E367G, N369I, Q370D, Q370H, Q370G, K371G, A375D, S377Y, Y387C, I397V, L399S, T405R, T409G, N410S, F424L, N429S, N429G, A436S, V439L, Q448L, C465S, K468Q, S473Y, K474T, E484D, I492V, E495G, K499E, P500L, T501P, P506S, D536E, or A539V by CVS numbering with reference to positions set forth in SEQ ID NO:2.

The modified valencene synthase polypeptides can contain any one or more of the recited amino acid substitutions, in any combination, in addition to a swap modification as described herein above.

Table 5A below sets forth exemplary modified valencene synthase polypeptides containing one or more swap modifications. The first amino acid (one-letter abbreviation) corresponds to the amino acid that is replaced with CVS numbering corresponding to the position in the valencene synthase polypeptide sequence with reference to SEQ ID NO: 2, and the second amino acid (one-letter abbreviation) corresponds to the amino acid selected that replaces the first amino acid at that position. It is understood that due to the swaps and insertion of new domains or regions, a modified valencene synthase can have greater or fewer amino acids compared to an unmodified valencene synthase not containing the swap. Thus, the amino acid numbering for the replacements can be altered. For purposes herein, reference to amino acid replacements is with reference to CVS numbering (see e.g. FIGS. 4A-D). Thus, for example, in the mutant designated V239 the amino acid replacement designated F209→I210 in Table 5A has a mutation F210I with respect to the valencene synthase polypeptide set forth in SEQ ID NO:743 or F209I by CVS numbering. Also provided is the sequence identifier (SEQ ID NO) that sets forth exemplary amino acid sequences and encoding nucleic acid sequences of the modified valencene synthase polypeptides.

TABLE 5A

CVS variants swaps

| Mut. | | SEQ ID NO | |
|---|---|---|---|
| No. | Mutation(s) | aa | nt |
| V228 | K24Q/Q38N/T53L/D54A/A55T/E56G/D57R/V60I/K88Q/Y93H/N97D/R98K/K125Q/K173Q/K184R/F209I/M212R/N214D/H219D/Y221V/E238D/K252Q/Q292K/Q321A/E333D/A345T/N369I/S377Y/T405R/N429G/A436S/T501P/D536E | 67 | 203 |
| V229 | K24Q/Q38N/T53L/D54A/A55T/E56G/D57R/V60I/K88Q/Y93H/N97D/R98K/K125Q/K173Q/K184R/F209I/M212R/N214D/H219D/Y221V/E238D/K252Q/P281S/Q292K/L313C/S314T/L315M/T317S/Q321A/E333D/K336R/L337I/A345T/N347L/G357R/N369I/S377Y/T405R/N429G/A436S/T501P/D536E | 350 | 352 |
| V230<br>V231 | K24Q/Q38N/T53L/D54A/A55T/E56G/D57R/V60I/K88Q/Y93H/N97D/R98K/K125Q/K173Q/K184R/F209I/M212R/N214D/H219D/Y221V/E238D/K252Q/P281S/Q292K/L313C/S314T/L315M/T317S/Q321A/E333D/K336R/L337I/A345T/G357R/N369I/S377Y/T405R/N429G/A436S/T501P/D536E | 351 | 353 |
| V232<br>V233<br>V234<br>V235<br>V236 | K24Q/Q38N/K58Q/V60I/K88Q/Y93H/N97D/R98K/K125Q/K173Q/L175→---/V176→---/Q178→A176/D179→P177/V181→L179/T182→K180/P183→S181/K184→P182/F209→I207/M212→R210/N214→D212/H219→D217/Y221→V219/E238→D236/K252→Q250/P281→S279/Q292→K290/L313→C311/S314→T312/L315→M313/T317→S315/Q321→A319/E333→D331/K336→R334/L337→I335/A345→T343/G357→R355/N369→I367/S377→Y375/T405→R403/N429→G427/A436→S434/T501→P499/D536→E534 | 732 | 702 |
| V237<br>and<br>V238 | S2R/S3D/G4K/E5G/F7C/K24Q/Q38N/K58Q/V60I/K88Q/Y93H/N97D/R98K/K125Q/K173Q/L175→---/V176→---/Q178→A176/D179→P177/V181→L179/T182→K180/P183→S181/K184→P182/F209→I207/M212→R210/N214→D212/H219→D217/Y221→V219/E238→D236/K252→Q250/P281→S279/Q292→K290/L313→C311/S314→T312/L315→M313/T317→S315/Q321→A319/E333→D331/K336→R334/L337→I335/A345→T343/G357→R355/N369→I367/S377→Y375/T405→R403/N429→G427/A436→S434/E484→D482/T501→P499/D536→E534 | 733 | 703 |
| V239 | K24Q/Q38N/T53L/D54A/A55T/E56G/D57R/V60I/A85M/I86L/Q87D/K88H/L89I/C90Y/---→R91/---→A92/--- | 743 | 713 |

TABLE 5A-continued

| CVS variants swaps | | | |
|---|---|---|---|
| Mut. | | SEQ ID NO | |
| No. | Mutation(s) | aa | nt |
| | →D93/I92→Y95/Y93→F96/I94→E97/D95→A98/S96→H99/N97→E100/R98→Y101/A99→N102/L111→S114/K125→Q128/K173→Q176/L175→---/V176→---/Q178→A179/D179→P180/V181→L182/T182→K183/P183→S184/K184→P185/F209→I210/M212→R213/N214→D215/H219→D220/Y221→V222/E238→D239/K252→Q253/P281→S282/Q292→K293/L313→C314/S314→T315/L315→M316/T317→S318/Q321→A322/E333→D334/K336→R337/L337→I338/A345→T346/G357→R358/N369→I370/S377→Y378/T405→R406/N429→G430/A436→S437/E484→D485/T501→P502/D536→E537 | | |
| V240 | R19K/K24Q/Q38N/T53L/D54A/A55T/E56G/D57R/V60I/A85M/I86L/Q87D/K88H/L89I/C90Y/---→R91/---→A92/---→D93/I92→Y95/Y93→F96/I94→E97/D95→A98/S96→H99/N97→E100/R98→Y101/A99→N102/K125→Q128/K173→Q176/L175→---/V176→---/Q178→A179/D179→P180/V181→L182/T182→K183/P183→S184/K184→P185/F209→I210/M212→R213/N214→D215/H219→D220/Y221→V222/E238→D239/K252→Q253/P281→S282/Q292→K293/L313→C314/S314→T315/L315→M316/T317→S318/Q321→A322/E333→D334/K336→R337/L337→I338/A345→T346/G357→R358/N369→I370/S377→Y378/T405→R406/N429→G430/A436→S437/E484→D485/T501→P502/D536→E537 | 744 | 714 |
| V241 | K24Q/Q38N/T53L/D54A/A55T/E56G/D57R/V60I/A85M/I86L/Q87D/K88H/L89I/C90Y/---→R91/---→A92/---→D93/I92→Y95/Y93→F96/I94→E97/D95→A98/S96→H99/N97→E100/R98→Y101/A99→N102/K125→Q128/K173→Q176/L175→---/V176→---/Q178→A179/D179→P180/V181→L182/T182→K183/P183→S184/K184→P185/F209→I210/M212→R213/N214→D215/H219→D220/Y221→V222/E238→D239/K252→Q253/P281→S282/Q292→K293/L313→C314/S314→T315/L315→M316/T317→S318/Q321→A322/E333→D334/K336→R337/L337→I338/A345→T346/G357→R358/N369→I370/S377→Y378/T405→R406/N429→G430/A436→S437/E484→D485/T501→P502/D536→E537 | 745 | 715 |
| V242 | K24Q/Q38N/K58Q/V60I/K88Q/Y93H/N97D/R98K/K125Q/K173Q/K184R/F209I/M212I/I213Y/N214E/S215→---/T216→---/S217→E215/D218→E216/H219→G217/L220→F218/Y221→K219/E238→D236/K252→Q250/P281→S279/Q292→K290/L313→C311/S314→T312/L315→M313/T317→S315/Q321→A319/E333→D331/K336→R334/L337→I335/A345→T343/G357→R355/N369→I367/S377→Y375/T405→R403/N429→G427/A436→S434/T501→P499/D536→E534 | 833 | 776 |
| V243 | R19K/K24Q/Q38N/T53L/D54A/A55T/E56G/D57R/V60I/A85M/I86L/Q87D/K88H/L89I/C90Y/---→R91/---→A92/---→D93/I92→Y95/Y93→F96/I94→E97/D95→A98/S96→H99/N97→E100/R98→Y101/A99→N102/K125→Q128/K173→Q176/L175→---/V176→---/Q178→A179/D179→P180/V181→L182/T182→K183/P183→S184/K184→P185/F209→I210/M212→S213/N214→Y215/S215→D216/T216→K217/S217--/D218E/H219Q/L220S/Y221K/E238D/K252Q/P281S/Q292K/L313C/S314T/L315M/T317S/Q321A/E333D/K336R/L337I/A345T/G357R/N369I/S377Y/T405R/N429G/A436S/E484D/T501P/D536E | 834 | 777 |
| V244 | R19K/K24Q/Q38N/T53L/D54A/A55T/E56G/D57R/V60I/A85M/I86L/Q87D/K88H/L89I/C90Y/---→R91/---→A92/---→D93/I92→Y95/Y93→F96/I94→E97/D95→A98/S96→H99/N97→E100/R98→Y101/A99→N102/K125→Q128/K173→Q176/L175→---/V176→---/Q178→A179/D179→P180/V181→L182/T182→K183/P183→S184/K184→P185/F209→I210/M212→S213/N214→Y215/S215→D216/T216→K217/S217--/D218E/H219Q/L220S/Y221K/E238D/K252Q/P281S/Q292K/L313C/S314T/L315M/T317S/Q321A/I325T/E333D/K336R/L337I/A345T/G357R/N369I/S377Y/T405R/N429G/A436S/E484D/T501P/D536E | 835 | 778 |
| V245 | R19K/K24Q/Q38N/T53L/D54A/A55T/E56G/D57R/V60I/A85M/I86L/Q87D/K88H/L89I/C90Y/--→R91/--→A92/--→D93/I92→Y95/Y93→F96/I94→E97/D95→A98/S96→H99/N97→E100/R98→Y101/A99→N102/K125→Q128/K173→Q176/L175→---/V176→---/Q178→A179/D179→P180/V181→L182/T182→K183/P183→S184/K184→P185/F209→I210/M212→V213/I213→Y214/N214→--/S215→--/T216→Q215/S217→D216/D218→E217/H219→A218/L220→F219/Y221→H220/E238→D237/K252→Q251/P281→S280/Q292→K291/L313→C312/S314→T313/L315→M314/T317→S316/Q321→A320/E333→D332/K336→R335/L337→I336/A345→T344/G357→R356/N369→I368/S377→Y376/T405→R404/N429→G428/A436→S435/E484→D483/T501→P500/D536→E535 | 836 | 779 |

TABLE 5A-continued

CVS variants swaps

| Mut. No. | Mutation(s) | SEQ ID NO aa | SEQ ID NO nt |
| --- | --- | --- | --- |
| V246 | R19K/K24Q/Q38N/T53L/D54A/A55T/E56G/D57R/V60I/A85M/I86L/Q87D/K88H/L89I/C90Y/---→R91/---→A92/---→D93/I92→Y95/Y93→F96/I94→E97/D95→A98/S96→H99/N97→E100/R98→Y101/A99→N102/K125→Q128/K173→Q176/L175→---/V176→---/Q178→A179/D179→P180/V181→L182/T182→K183/P183→S184/K184→P185/F209→I210/M212→Y213/I213→S214/N214→P215/S215→N216/T216→V217/S217→I218/H219→L220/L220→A221/Y221→P222/E238→D239/K252→Q253/Q292→K293/Q321→A322/E333→D334/A345→T346/N369→I370/S377→Y378/T405→R406/N429→G430/A436→S437/T501→P502/D536→E537 | 837 | 780 |
| V247 | R19K/K24Q/Q38N/T53L/D54A/A55T/E56G/D57R/V60I/A85M/I86L/Q87D/K88H/L89I/C90Y/---→R91/---→A92/---→D93/I92→Y95/Y93→F96/I94→E97/D95→A98/S96→H99/N97→E100/R98→Y101/A99→N102/K125→Q128/K173→Q176/L175→---/V176→---/Q178→A179/D179→P180/V181→L182/T182→K183/P183→S184/K184→P185/F209→I210/M212→K213/I213→P214/N214→V215/S215→T216/T216→R217/D218→L219/H219→S220/L220→A221/Y221→L222/E238→D239/K252→Q253/Q292→K293/V320→A321/Q321→A322/E333→D334/A345→T346/N369→I370/S377→Y378/T405→R406/N429→G430/A436→S437/T501→P502/D536→E537 | 838 | 781 |
| V248 | R19K/K24Q/Q38N/T53L/D54A/A55T/E56G/D57R/V60I/A85M/I86L/Q87D/K88H/L89I/C90Y/---→R91/---→A92/---→D93/I92→Y95/Y93→F96/I94→E97/D95→A98/S96→H99/N97→E100/R98→Y101/A99→N102/K125→Q128/K173→Q176/L175→---/V176→---/Q178→A179/D179→P180/V181→L182/T182→K183/P183→S184/K184→P185/F209→I210/I213→Q214/N214→H215/S215→L216/T216→C217/S217→F218/D218→S219/H219→R220/L220→H221/Y221→K222/E238→D239/K252→Q253/Q292→K293/Q321→A322/E333→D334/A345→T346/N369→I370/S377→Y378/T405→R406/N429→G430/A436→S437/T501→P502/D536→E537 | 839 | 782 |
| V249 | R19K/K24Q/Q38N/T53L/D54A/A55T/E56G/D57R/V60I/A85M/I86L/Q87D/K88H/L89I/C90Y/---→R91/---→A92/---→D93/I92→Y95/Y93→F96/I94→E97/D95→A98/S96→H99/N97→E100/R98→Y101/A99→N102/K125→Q128/K173→Q176/L175→---/V176→---/Q178→A179/D179→P180/V181→L182/T182→K183/P183→S184/K184→P185/F209→I210/M212→F213/I213→N214/N214→C215/S215→V216/T216→K217/S217→Y218/D218→A219/H219→F220/L220→T221/Y221→Q222/E238→D239/K252→Q253/Q292→K293/Q321→A322/E333→D334/A345→T346/N369→I370/S377→Y378/T405→R406/N429→G430/A436→S437/T501→P502/D536→E537 | 840 | 783 |
| V250 | R19K/K24Q/Q38N/T53L/D54A/A55T/E56G/D57R/V60I/A85M/I86L/Q87D/K88H/L89I/C90Y/---→R91/---→A92/---→D93/I92→Y95/Y93→F96/I94→E97/D95→A98/S96→H99/N97→E100/R98→Y101/A99→N102/K125→Q128/K173→Q176/L175→---/V176→---/Q178→A179/D179→P180/V181→L182/T182→K183/P183→S184/K184→P185/F209→I210/M212→Y213/I213→R214/N214→L215/S215→N216/T216→D217/S217→N218/D218→Y219/H219→A220/L220→E221/Y221→W222/E238→D239/K252→Q253/Q292→K293/Q321→A322/E333→D334/A345→T346/N369→I370/S377→Y378/T405→R406/N429→G430/A436→S437/T501→P502/D536→E537 | 841 | 784 |
| V251 | K24Q/D28G/Q38N/T53L/D54A/A55T/E56G/D57R/V60I/K62R/A85M/I86L/Q87D/K88H/L89I/C90Y/---→R91/---→A92/---→D93/I92→Y95/Y93→F96/I94→E97/D95→A98/S96→H99/N97→E100/R98→Y101/A99→N102/K125→Q128/K173→Q176/L175→---/V176→---/Q178→A179/D179→P180/V181→L182/T182→K183/P183→S184/K184→P185/F209→I210/M212→S213/I213→K214/N214→A215/S215→Q216/T216→A217/S217→H218/D218→S219/H219→L220/L220→V221/Y221→S222/E238→D239/K252→Q253/Q292→K293/Q321→A322/E333→D334/A345→T346/N369→I370/S377→Y378/T405→R406/N429→G430/A436→S437/T501→P502/D536→E537 | 842 | 785 |
| V252 | K24Q/Q38N/T53L/D54A/A55T/E56G/D57R/V60I/K62R/A85M/I86L/Q87D/K88H/L89I/C90Y/---→R91/---→A92/---→D93/I92→Y95/Y93→F96/I94→E97/D95→A98/S96→H99/N97→E100/R98→Y101/A99→N102/K125→Q128/K173→Q176/L175→---/V176→---/Q178→A179/D179→P180/V181→L182/T182→K183/P183→S184/K184→P185/F209→I210/M212→S213/I213→L214/N214→V215/S215→R216/T216→S217/S217→E218/D218→K219/H219→D220/L220→P221/Y221→N222/E238→D239/K252→Q253/Q292→K293/Q321→A322/E333→D334/A345→T346/N369→I370/ | 843 | 786 |

TABLE 5A-continued

| CVS variants swaps | | | |
|---|---|---|---|
| Mut. | | SEQ ID NO | |
| No. | Mutation(s) | aa | nt |
| | S377→Y378/T405→R406/N429→G430/A436→S437/T501→P502/ D536→E537 | | |
| V253 | R19K/K24Q/Q38N/T53L/D54A/A55T/E56G/D57R/V60I/A85M/ I86L/Q87D/K88H/L89I/C90Y/---→R91/---→A92/---→D93/ I92→Y95/Y93→F96/I94→E97/D95→A98/S96→H99/N97→E100/ R98→Y101/A99→N102/K125→Q128/K173→Q176/L175→---/ V176→---/Q178→A179/D179→P180/V181→L182/T182→K183/ P183→S184/K184→P185/F209→I210/M212→H213/I213→R214/ N214→T215/S215→P216/T216→A217/S217→F218/D218→C219/ H219→R220/L220→G221/Y221→E222/E238→D239/K252→Q253/ Q292→K293/Q321→A322/E333→D334/A345→T346/N369→I370/ S377→Y378/T405→R406/N429→G430/A436→S437/T501→P502/ D536→E537 | 844 | 787 |
| V254 | R19K/K24Q/Q38N/T53L/D54A/A55T/E56G/D57R/V60I/A85M/ I86L/Q87D/K88H/L89I/C90Y/---→R91/---→A92/---→D93/ I92→Y95/Y93→F96/I94→E97/D95→A98/S96→H99/N97→E100/ R98→Y101/A99→N102/K125→Q128/K173→Q176/L175→---/ V176→---/Q178→A179/D179→P180/V181→L182/T182→K183/ P183→S184/K184→P185/F209→I210/M212→Q213/I213→V214/ N214→R215/S215→K216/T216→R217/S217→C218/D218→V219/ H219→E220/L220→A221/Y221→V222/E238→D239/K252→Q253/ Q292→K293/Q321→A322/E333→D334/A345→T346/N369→I370/ S377→Y378/T405→R406/N429→G430/A436→S437/T501→P502/ D536→E537 | 845 | 788 |
| V255 | R19K/K24Q/Q38N/T53L/D54A/A55T/E56G/D57R/V60I/A85M/ I86L/Q87D/K88H/L89I/C90Y/---→R91/---→A92/---→D93/ I92→Y95/Y93→F96/I94→E97/D95→A98/S96→H99/N97→E100/ R98→Y101/A99→N102/K125→Q128/K173→Q176/L175→---/ V176→---/Q178→A179/D179→P180/V181→L182/T182→K183/ P183→S184/K184→P185/F209→I210/M212→V213/I213→Y214/ N214→---/S215→---/T216→Q215/S217→D216/D218→E217/ H219→A218/L220→F219/Y221→H220/E238→D237/K252→Q251/ P281→S280/Q292→K291/L313→C312/S314→T313/L315→M314/ T317→S316/Q321→A320/E333→D332/K336→R335/L337→I336/ A345→T344/G357→R356/N369→I368/S377→Y376/T405→R404/ N429→G428/A436→S435/Q448→L447/E484→D483/T501→P500/ D536→E535// | 846 | 789 |
| V256 | S2Q/S3T/G4F/E5N/T6C/F7A/R19K/K24Q/Q38N/T53L/D54A/ A55T/E56G/D57R/V60I/A85M/I86L/Q87D/K88H/L89I/C90Y/--- →R91/---→A92/---→D93/I92→Y95/Y93→F96/I94→E97/ D95→A98/S96→H99/N97→E100/R98→Y101/A99→N102/ K125→Q128/K173→Q176/L175→---/V176→---/Q178→A179/ D179→P180/V181→L182/T182→K183/P183→S184/K184→P185/ F209→I210/M212→S213/N214→Y215/S215→D216/T216→K217/ S217--/D218E/H219Q/L220S/Y221K/E238D/K252Q/P281S/Q292K/ L313C/S314T/L315M/T317S/Q321A/E333D/K336R/L337I/A345T/ G357R/N369I/S377Y/T405R/N429G/A436S/E484D/T501P/D536E | 847 | 790 |
| V257 | S2A/S3G/G4R/E5G/T6A/F7S/R19K/K24Q/Q38N/T53L/D54A/ A55T/E56G/D57R/V60I/A85M/I86L/Q87D/K88H/L89I/C90Y/--- →R91/---→A92/---→D93/I92→Y95/Y93→F96/I94→E97/ D95→A98/S96→H99/N97→E100/R98→Y101/A99→N102/ K125→Q128/K173→Q176/L175→---/V176→---/Q178→A179/ D179→P180/V181→L182/T182→K183/P183→S184/K184→P185/ F209→I210/M212→S213/N214→Y215/S215→D216/T216→K217/ S217--/D218E/H219Q/L220S/Y221K/E238D/K252Q/P281S/Q292K/ L313C/S314T/L315M/T317S/Q321A/E333D/K336R/L337I/A345T/ G357R/N369I/S377Y/T405R/N429G/A436S/E484D/T501P/D536E | 848 | 791 |
| V258 | S2V/S3L/G4K/E5S/T6K/F7R/R19K/K24Q/Q38N/T53L/D54A/ A55T/E56G/D57R/V60I/A85M/I86L/Q87D/K88H/L89I/C90Y/---→ R91/---→A92/---→D93/I92→Y95/Y93→F96/I94→E97/ D95→A98/S96→H99/N97→E100/R98→Y101/A99→N102/ K125→Q128/K173→Q176/L175→---/V176→---/Q178→A179/ D179→P180/V181→L182/T182→K183/P183→S184/K184→P185/ F209→I210/M212→S213/N214→Y215/S215→D216/T216→K217/ S217--/D218E/H219Q/L220S/Y221K/E238D/K252Q/P281S/Q292K/ L313C/S314T/L315M/T317S/Q321A/E333D/K336R/L337I/A345T/ G357R/N369I/S377Y/T405R/N429G/A436S/E484D/T501P/D536E | 849 | 792 |
| V259 and V260 | S2K/S3E/G4C/E5T/T6M/F7L/R19K/K24Q/Q38N/T53L/D54A/ A55T/E56G/D57R/V60I/A85M/I86L/Q87D/K88H/L89I/C90Y/---→ R91/---→A92/---→D93/I92→Y95/Y93→F96/I94→E97/ D95→A98/S96→H99/N97→E100/R98→Y101/A99→N102/ K125→Q128/K173→Q176/L175→---/V176→---/Q178→A179/ D179→P180/V181→L182/T182→K183/P183→S184/K184→P185/ | 850 | 793 |

TABLE 5A-continued

CVS variants swaps

| Mut. No. | Mutation(s) | SEQ ID NO aa | SEQ ID NO nt |
|---|---|---|---|
| | F209→I210/M212→S213/N214→Y215/S215→D216/T216→K217/S217--/D218E/H219Q/L220S/Y221K/E238D/K252Q/P281S/Q292K/L313C/S314T/L315M/T317S/Q321A/E333D/K336R/L337I/A345T/G357R/N369I/S377Y/T405R/N429G/A436S/E484D/T501P/D536E | | |
| V261 and V262 | S2P/R19K/K24Q/Q38N/T53L/D54A/A55T/E56G/D57R/V60I/A85M/I86L/Q87D/K88H/L89I/C90Y/---→R91/---→A92/---→D93/I92→Y95/Y93→F96/I94→E97/D95→A98/S96→H99/N97→E100/R98→Y101/A99→N102/K125→Q128/K173→Q176/L175→---/V176→---/Q178→A179/D179→P180/V181→L182/T182→K183/P183→S184/K184→P185/F209→I210/M212→S213/N214→Y215/S215→D216/T216→K217/S217--/D218E/H219Q/L220S/Y221K/E238D/K252Q/P281S/Q292K/L313C/S314T/L315M/T317S/Q321A/E333D/K336R/L337I/A345T/G357R/N369I/S377Y/T405R/N429G/A436S/E484D/T501P/D536E | 851 | 794 |
| V263 | S2C/S3M/G4T/E5G/T6E/F7S/R19K/K24Q/Q38N/T53L/D54A/A55T/E56G/D57R/V60I/A85M/I86L/Q87D/K88H/L89I/C90Y/---→R91/---→A92/---→D93/I92→Y95/Y93→F96/I94→E97/D95→A98/S96→H99/N97→E100/R98→Y101/A99→N102/K125→Q128/K173→Q176/L175→---/V176→---/Q178→A179/D179→P180/V181→L182/T182→K183/P183→S184/K184→P185/F209→I210/M212→S213/N214→Y215/S215→D216/T216→K217/S217--/D218E/H219Q/L220S/Y221K/E238D/K252Q/P281S/Q292K/L313C/S314T/L315M/T317S/Q321A/E333D/K336R/L337I/A345T/G357R/N369I/S377Y/T405R/N429G/A436S/E484D/T501P/D536E | 852 | 795 |
| V264 | S2Q/S3N/G4L/E5G/T6Y/F7S/R19K/K24Q/Q38N/T53L/D54A/A55T/E56G/D57R/V60I/A85M/I86L/Q87D/K88H/L89I/C90Y/---→R91/---→A92/---→D93/I92→Y95/Y93→F96/I94→E97/D95→A98/S96→H99/N97→E100/R98→Y101/A99→N102/K125→Q128/K173→Q176/L175→---/V176→---/Q178→A179/D179→P180/V181→L182/T182→K183/P183→S184/K184→P185/F209→I210/M212→S213/N214→Y215/S215→D216/T216→K217/S217--/D218E/H219Q/L220S/Y221K/E238D/K252Q/P281S/Q292K/L313C/S314T/L315M/T317S/Q321A/E333D/K336R/L337I/A345T/G357R/N369I/S377Y/T405R/N429G/A436S/E484D/T501P/D536E | 853 | 796 |
| V265 | S2L/S3N/G4S/E5I/T6D/F7S/R19K/K24Q/Q38N/T53L/D54A/A55T/E56G/D57R/V60I/A85M/I86L/Q87D/K88H/L89I/C90Y/---→R91/---→A92/---→D93/I92→Y95/Y93→F96/I94→E97/D95→A98/S96→H99/N97→E100/R98→Y101/A99→N102/K125→Q128/K173→Q176/L175→---/V176→---/Q178→A179/D179→P180/V181→L182/T182→K183/P183→S184/K184→P185/F209→I210/M212→S213/N214→Y215/S215→D216/T216→K217/S217--/D218E/H219Q/L220S/Y221K/E238D/K252Q/P281S/Q292K/L313C/S314T/L315M/T317S/Q321A/E333D/K336R/L337I/A345T/G357R/N369I/S377Y/T405R/N429G/A436S/E484D/T501P/D536E | 854 | 797 |
| V266 | S2P/S3D/G4R/E5T/T6G/F7P/R19K/K24Q/Q38N/T53L/D54A/A55T/E56G/D57R/V60I/A85M/I86L/Q87D/K88H/L89I/C90Y/---→R91/---→A92/---→D93/I92→Y95/Y93→F96/I94→E97/D95→A98/S96→H99/N97→E100/R98→Y101/A99→N102/K125→Q128/K173→Q176/L175→---/V176→---/Q178→A179/D179→P180/V181→L182/T182→K183/P183→S184/K184→P185/F209→I210/M212→S213/N214→Y215/S215→D216/T216→K217/S217--/D218E/H219Q/L220S/Y221K/E238D/K252Q/P281S/Q292K/L313C/S314T/L315M/T317S/Q321A/E333D/K336R/L337I/A345T/G357R/N369I/S377Y/T405R/N429G/A436S/E484D/T501P/D536E | 855 | 798 |
| V267 | R19K/K24Q/Q38N/T53L/D54A/A55T/E56G/D57R/V60I/A85M/I86L/Q87D/K88H/L89I/C90Y/---→R91/---→A92/---→D93/I92→Y95/Y93→F96/I94→E97/D95→A98/S96→H99/N97→E100/R98→Y101/A99→N102/K125→Q128/K173→Q176/L175→---/V176→---/Q178→A179/D179→P180/V181→L182/T182→K183/P183→S184/K184→P185/F209→I210/M212→R213/N214→D215/H219→D220/Y221→V222/E238→D239/K252→Q253/P281→S282/Q292→K293/L313→C314/S314→T315/L315→M316/T317→S318/Q321→A322/E333→D334/K336→R337/L337→I338/A345→T346/G357→R358/N369→I370/S377→Y378/T405→R406/N429→G430/A436→S437/E484→D485/T501→P502/D536→E537 | 856 | 799 |
| V268 | R19K/K24Q/Q38N/T53L/D54A/A55T/E56G/D57R/V60I/A85M/I86L/Q87D/K88H/L89I/C90Y/---→R91/---→A92/---→D93/I92→Y95/Y93→F96/I94→E97/D95→A98/S96→H99/N97→E100/R98→Y101/A99→N102/K125→Q128/K173→Q176/L175→---/V176→---/Q178→A179/D179→P180/V181→L182/T182→K183/P183→S184/K184→P185/F209→E210/M212→R213/N214→D215/H219→D220/Y221→V222/E238→D239/K252→Q253/P281→S282/Q292→K293/L313→C314/S314→T315/L315→M316/T317→S318/ | 858 | 801 |

TABLE 5A-continued

| CVS variants swaps | | | |
|---|---|---|---|
| Mut. | | SEQ ID NO | |
| No. | Mutation(s) | aa | nt |
| | Q321→A322/E333→D334/K336→R337/L337→I338/A345→T346/G357→R358/N369→I370/S377→Y378/T405→R406/N429→G430/A436→S437/E484→D485/T501→P502/D536→E537 | | |
| V269 | K24Q/Q38N/T53L/D54A/A55T/E56G/D57R/V60I/A85M/I86L/Q87D/K88H/L89I/C90Y/---→R91/---→A92/---→D93/I92→Y95/Y93→F96/I94→E97/D95→A98/S96→H99/N97→E100/R98→Y101/A99→N102/L111→S114/K125→Q128/K173→Q176/L175→---/V176→---/Q178→A179/D179→P180/V181→L182/T182→K183/P183→S184/K184→P185/F209→E210/M212→R213/N214→D215/H219→D220/Y221→V222/E238→D239/K252→Q253/P281→S282/Q292→K293/L313→C314/S314→T315/L315→M316/T317→S318/Q321→A322/E333→D334/K336→R337/L337→I338/A345→T346/G357→R358/N369→I370/S377→Y378/T405→R406/N429→G430/A436→S437/E484→D485/T501→P502/D536→E537 | 859 | 802 |
| V270 | R19K/K24Q/Q38N/T53L/D54A/A55T/E56G/D57R/V60I/A85M/I86L/Q87D/K88H/L89I/C90Y/---→R91/---→A92/---→D93/I92→Y95/Y93→F96/I94→E97/D95→A98/S96→H99/N97→E100/R98→Y101/A99→N102/K125→Q128/K173→Q176/L175→---/V176→---/Q178→A179/D179→P180/V181→L182/T182→K183/P183→S184/K184→P185/F209→L210/M212→R213/N214→D215/H219→D220/Y221→V222/E238→D239/K252→Q253/P281→S282/Q292→K293/L313→C314/S314→T315/L315→M316/T317→S318/Q321→A322/E333→D334/K336→R337/L337→I338/A345→T346/G357→R358/N369→I370/S377→Y378/T405→R406/N429→G430/A436→S437/E484→D485/T501→P502/D536→E537 | 860 | 803 |
| V271 | R19K/K24Q/Q38N/T53L/D54A/A55T/E56G/D57R/V60I/A85M/I86L/Q87D/K88H/L89I/C90Y/---→R91/---→A92/---→D93/I92→Y95/Y93→F96/I94→E97/D95→A98/S96→H99/N97→E100/R98→Y101/A99→N102/K125→Q128/K173→Q176/L175→---/V176→---/Q178→A179/D179→P180/V181→L182/T182→K183/P183→S184/K184→P185/F209→T210/M212→R213/N214→D215/H219→D220/Y221→V222/E238→D239/K252→Q253/P281→S282/Q292→K293/L313→C314/S314→T315/L315→M316/T317→S318/Q321→A322/E333→D334/K336→R337/L337→I338/A345→T346/G357→R358/N369→I370/S377→Y378/T405→R406/N429→G430/A436→S437/E484→D485/T501→P502/D536→E537 | 861 | 804 |
| V272 | R19K/K24Q/Q38N/T53L/D54A/A55T/E56G/D57R/V60I/A85M/I86L/Q87D/K88H/L89I/C90Y/---→R91/---→A92/---→D93/I92→Y95/Y93→F96/I94→E97/D95→A98/S96→H99/N97→E100/R98→Y101/A99→N102/K125→Q128/K173→Q176/L175→---/V176→---/Q178→A179/D179→P180/V181→L182/T182→K183/P183→S184/K184→P185/F209→I210/M212→A213/I213→F214/N214→L215/S215→A216/T216→C217/S217→G218/D218→R219/H219→R220/L220→P221/Y221→T222/E238→D239/K252→Q253/Q292→K293/L313→C314/S314→T315/L315→M316/T317→S318/Q321→A322/E333→D334/K336→R337/L337→I338/A345→T346/G357→R358/N369→I370/S377→Y378/T405→R406/N429→G430/A436→S437/T501→P502/D536→E537 | 862 | 805 |
| V273 | S2A/S3T/G4S/E5H/T6S/F7Q/R19K/K24Q/Q38N/T53L/D54A/A55T/E56G/D57R/V60I/A85M/I86L/Q87D/K88H/L89I/C90Y/---→R91/---→A92/---→D93/I92→Y95/Y93→F96/I94→E97/D95→A98/S96→H99/N97→E100/R98→Y101/A99→N102/K125→Q128/K173→Q176/L175→---/V176→---/Q178→A179/D179→P180/V181→L182/T182→K183/P183→S184/K184→P185/F209→I210/M212→S213/N214→Y215/S215→D216/T216→K217/S217--/D218E/H219Q/L220S/Y221K/E238D/K252Q/P281S/Q292K/L313C/S314T/L315M/T317S/Q321A/I325T/E333D/K336R/L337I/A345T/G357R/N369I/S377Y/T405R/N429G/A436S/E484D/T501P/D536E | 863 | 806 |
| V274 | S3T/G4Q/E5V/---→S6/---→A7/---→S8/---→S9/---→L10/---→A11/---→Q12/---→I13/---→P14/---→Q15/---→P16/T6→K17/F7→N18/T10→V21/D12→N23/S16→N27/L17→I28/R19→G30/N20→D31/H21→Q32/L23→I34/K24→T35/G25→Y36/A26→T37/S27→P38/D28→E39/F29→D40/T31→---/D33→T43/H34→R44/T35→A45/A36→C46/T37→K47/Q38→E48/R40→Q50/H41→I51/T53→L63/D54→A64/A55→T65/E56→G66/D57→R67/V60→I70/A85→M95/I86→L96/Q87→D97/K88→H98/L89→I99/C90→Y100/---→R101/---→A102/---→D103/I92→Y105/Y93→F106/I94→E107/D95→A108/S96→H109/N97→E110/R98→Y111/A99→N112/K125→Q138/K173→Q186/L175→---/V176→---/Q178→A189/D179→P190/V181→L192/T182→K193/P183→S194/K184→P195/F209→I220/M212→R223/N214→D225/H219→D230/Y221→V232/E238→D249/K252→Q263/P281→S292/Q292→K303/L313→C324/S314→T325/ | 864 | 807 |

TABLE 5A-continued

CVS variants swaps

| Mut. No. | Mutation(s) | SEQ ID NO aa | SEQ ID NO nt |
|---|---|---|---|
| | L315→M326/T317→S328/Q321→A332/E333→D344/K336→R347/L337→I348/A345→T356/G357→R368/N369→I380/S377→Y388/T405→R416/N429→G440/A436→S447/E484→D495/T501→P512/D536→E547 | | |
| V275 | K24Q/Q38N/K58Q/V60I/I86L/K88H/L89I/P91N/I92N/Y93F/I94H/S96C/R98D/A99M/---→G101/---→D102/K125→Q127/K173→Q175/K184→R186/F209→I211/M212→R214/N214→D216/H219→D221/Y221→V223/E238→D240/K252→Q254/P281→S283/Q292→K294/L313→C315/S314→T316/L315→M317/T317→S319/Q321→A323/E333→D335/K336→R338/L337→I339/A345→T347/G357→R359/N369→I371/S377→Y379/T405→R407/N429→G431/A436→S438/T501→P503/D536→E538 | 865 | 808 |
| V276 | K24Q/Q38N/K58Q/V60I/I86L/K88H/L89I/P91N/I92S/Y93F/I94H/S96C/R98D/A99M/---→G101/---→D102/K125→Q127/K173→Q175/K184→R186/F209→I211/M212→R214/N214→D216/H219→D221/Y221→V223/E238→D240/K252→Q254/P281→S283/Q292→K294/L313→C315/S314→T316/L315→M317/T317→S319/Q321→A323/E333→D335/K336→R338/L337→I339/A345→T347/G357→R359/N369→I371/S377→Y379/Y387→C389/T405→R407/N429→G431/A436→S438/T501→P503/D536→E538 | 866 | 809 |
| V277 | S3T/G4Q/E5V/---→S6/---→A7/---→S8/---→S9/---→L10/---→A11/---→Q12/---→I13/---→P14/---→Q15/---→P16/T6→K17/F7→N18/T10→V21/D12→N23/S16→N27/L17→I28/R19→G30/N20→D31/H21→Q32/L23→I34/K24→T35/G25→Y36/A26→T37/S27→P38/D28→E39/F29→D40/T31→---/D33→T43/H34→R44/T35→A45/A36→C46/T37→K47/Q38→E48/R40→Q50/H41→I51/T53→L63/D54→A64/A55→T65/E56→G66/D57→R67/V60→I70/A85→M95/I86→L96/Q87→D97/K88→H98/L89→I99/C90→Y100/---→R101/---→A102/---→D103/I92→Y105/Y93→F106/I94→E107/D95→A108/S96→H109/N97→E110/R98→Y111/A99→N112/K125→Q138/K173→Q186/L175→---/V176→---/Q178→A189/D179→P190/V181→L192/T182→K193/P183→S194/K184→P195/F209→I220/M212→V223/I213→Y224/N214→---/S215→---/T216→Q225/S217→D226/D218→E227/H219→A228/L220→F229/Y221→H230/E238→D247/K252→Q261/P281→S290/Q292→K301/L313→C322/S314→T323/L315→M324/T317→S326/Q321→A330/E333→D342/K336→R345/L337→I346/A345→T354/G357→R366/N369→I378/S377→Y386/T405→R414/N429→G438/A436→S445/E484→D493/T501→P510/D536→E545 | 887 | 891 |
| V278 | R19K/K24Q/Q38N/T53L/D54A/A55T/E56G/D57R/V60I/A85M/I86L/Q87D/K88H/L89I/C90Y/---→R91/---→A92/---→D93/I92→Y95/Y93→F96/I94→E97/D95→A98/S96→H99/N97→E100/R98→Y101/A99→N102/K125→Q128/K173→Q176/L175→---/V176→---/Q178→A179/D179→P180/V181→L182/T182→K183/P183→S184/K184→P185/F209→I210/M212→R213/N214→V215/H219→D220/Y221→V222/E238→D239/K252→Q253/P281→S282/Q292→K293/L313→C314/S314→T315/L315→M316/T317→S318/Q321→A322/E333→D334/K336→R337/L337→I338/A345→T346/G357→R358/N369→I370/S377→Y378/T405→R406/N429→G430/A436→S437/E484→D485/T501→P502/P506→S507/D536→E537 | 888 | 892 |
| V279 | R19K/K24Q/Q38N/T53L/D54A/A55T/E56G/D57R/V60I/A85M/I86L/Q87D/K88H/L89I/C90Y/---→R91/---→A92/---→D93/I92→Y95/Y93→F96/I94→E97/D95→A98/S96→H99/N97→E100/R98→Y101/A99→N102/K125→Q128/K173→Q176/L175→---/V176→---/Q178→A179/D179→P180/V181→L182/T182→K183/P183→S184/K184→P185/F209→I210/M212→R213/N214→D215/H219→D220/Y221→V222/E238→D239/K252→Q253/T257→A258/P281→S282/Q292→K293/L313→C314/S314→T315/L315→M316/T317→S318/Q321→A322/E333→D334/K336→R337/L337→I338/A345→T346/G357→R358/N369→I370/S377→Y378/T405→R406/N410→S411/N429→G430/A436→S437/E484→D485/T501→P502/D536→E537 | 889 | 893 |
| V280 | R19K/K24Q/Q38N/T53L/D54A/A55T/E56G/D57R/V69L/A85M/I86L/Q87D/K88H/L89I/C90Y/---→R91/---→A92/---→D93/I92→Y95/Y93→F96/I94→E97/D95→A98/S96→H99/N97→E100/R98→Y101/A99→N102/K125→Q128/K173→Q176/L175→---/V176→---/Q178→A179/D179→P180/V181→L182/T182→K183/P183→S184/K184→P185/F209→I210/M212→R213/N214→D215/H219→D220/Y221→V222/E238→D239/K252→Q253/P281→S282/Q292→K293/L313→C314/S314→T315/L315→M316/T317→S318/Q321→A322/E333→D334/K336→R337/L337→I338/A345→T346/G357→R358/N369→I370/S377→Y378/T405→R406/N429→G430/A436→S437/E484→D485/T501→P502/D536→E537 | 890 | 894 |

TABLE 5A-continued

| CVS variants swaps | | | |
|---|---|---|---|
| Mut. | | SEQ ID NO | |
| No. | Mutation(s) | aa | nt |
| V281 | R19K/K24P/Q38Y/T53L/D54A/A55T/E56G/D57R/V60I/A85M/I86L/Q87D/K88H/L89I/C90Y/---→R91/---→A92/---→D93/I92→Y95/Y93→F96/I94→E97/D95→A98/S96→H99/N97→E100/R98→Y101/A99→N102/K125→Q128/K173→Q176/L175→---/V176→---/Q178→A179/D179→P180/V181→L182/T182→K183/P183→S184/K184→P185/F209→I210/M212→V213/I213→Y214/N214→---/S215→---/T216→Q215/S217→D216/D218→E217/H219→A218/L220→F219/Y221→H220/E238→D237/K252→Q251/P281→S280/Q292→K291/L313→C312/S314→T313/L315→M314/T317→S316/Q321→A320/E333→D332/K336→R335/L337→I336/A345→T344/G357→R356/N369→I368/S377→Y376/T405→R404/N429→G428/A436→S435/E484→D483/T501→P500/D536→E535 | 895 | 896 |
| V287 | S2K/S3E/G4C/E5T/T6M/F7L/R19K/K24Q/Q38N/T53L/D54A/A55T/E56G/D57R/V60I/A85M/I86L/Q87D/K88H/L89I/C90Y/---→R91/---→A92/---→D93/I92→Y95/Y93→F96/I94→E97/D95→A98/S96→H99/N97→E100/R98→Y101/A99→N102/K125→Q128/K173→Q176/L175→---/V176→---/Q178→A179/D179→P180/V181→L182/T182→K183/P183→S184/K184→P185/F209→I210/M212→S213/N214→Y215/S215→D216/T216→K217/S217→---/D218E/H219Q/L220S/Y221K/E238D/K252Q/P281S/Q292K/L313C/S314T/L315M/T317S/Q321A/E333D/K336R/L337I/A345T/G357R/N369I/S377Y/T405R/N429G/A436S/E484D/T501P/D536E | 944 | 945 |
| V288 | S2K/S3E/G4C/E5T/T6M/F7L/R19K/K24Q/Q38N/T53L/D54A/A55T/E56G/D57R/V60I/A85M/I86L/Q87D/K88H/L89I/C90Y/---→R91/---→A92/---→D93/I92→Y95/Y93→F96/I94→E97/D95→A98/S96→H99/N97→E100/R98→Y101/A99→N102/K125→Q128/K173→Q176/L175→---/V176→---/Q178→A179/D179→P180/V181→L182/T182→K183/P183→S184/K184→P185/F209→I210/M212→S213/N214→Y215/S215→D216/T216→K217/S217→---/D218E/H219Q/L220S/Y221K/E238D/K252Q/P281S/Q292K/L313C/S314A/L315M/T317S/Q321A/E333D/K336R/L337I/A345T/E348A/G357R/N369I/S377Y/T405R/N429G/A436S/E484D/T501P/D536E | 946 | 947 |
| V289 | S2C/S3M/G4T/E5G/T6E/F7S/R19K/K24Q/Q38N/T53L/D54A/A55T/E56G/D57R/V60I/A85M/I86L/Q87D/K88H/L89I/C90Y/---→R91/---→A92/---→D93/I92→Y95/Y93→F96/I94→E97/D95→A98/S96→H99/N97→E100/R98→Y101/A99→N102/K125→Q128/K173→Q176/L175→---/V176→---/Q178→A179/D179→P180/V181→L182/T182→K183/P183→S184/K184→P185/F209→I210/M212→S213/N214→Y215/S215→D216/T216→K217/S217→---/D218E/H219Q/L220S/Y221K/E238D/K252Q/P281S/Q292K/L313C/S314T/L315M/T317S/Q321A/E333D/K336R/L337I/A345T/G357R/N369I/S377Y/T405R/N429G/A436S/E484D/T501P/D536E | 948 | 949 |
| V290 | S2C/S3M/G4T/E5G/T6E/F7S/R19K/K24Q/Q38N/T53L/D54A/A55T/E56G/D57R/V60I/A85M/I86L/Q87D/K88H/L89I/C90Y/---→R91/---→A92/---→D93/I92→Y95/Y93→F96/I94→E97/D95→A98/S96→H99/N97→E100/R98→Y101/A99→N102/K125→Q128/K173→Q176/L175→---/V176→---/Q178→A179/D179→P180/V181→L182/T182→K183/P183→S184/K184→P185/F209→I210/M212→S213/N214→Y215/S215→D216/T216→K217/S217→---/D218E/H219Q/L220S/Y221K/E238D/K252Q/P281S/Q292K/L313C/S314T/L315M/T317S/Q321A/E333D/K336R/L337I/A345T/G357R/N369I/S377Y/T405R/N429G/A436S/E484D/T501P/D536E | 950 | 951 |
| V292 | R19K/K24Q/Q38N/T53L/D54A/A55T/E56G/D57R/V60I/A85M/I86L/Q87D/K88H/L89I/C90Y/---→R91/---→A92/---→D93/I92→Y95/Y93→F96/I94→E97/D95→A98/S96→H99/N97→E100/R98→Y101/A99→N102/K125→Q128/K173→Q176/L175→---/V176→---/Q178→A179/D179→P180/V181→L182/T182→K183/P183→S184/K184→P185/F209→I210/M212→V213/I213→Y214/N214→---/S215→--214/T216→Q215/S217→D216/D218→E217/H219→A218/L220→F219/Y221→H220/E238→D237/K252→Q251/P281→S280/Q292→K291/L313→C312/S314→T313/L315→M314/T317→S316/Q321→A320/E333→D332/K336→R335/L337→I336/A345→T344/G357→R356/N369→I368/S377→Y376/T405→R404/N429→G428/A436→S435/V439→L438/E484→D483/T501→P500/D536→E535 | 952 | 953 |
| V293 | S2A/S3G/G4E/E5A/F7G/R19K/K24Q/Q38N/T53L/D54A/A55T/E56G/D57R/V60I/A85M/I86L/Q87D/K88H/L89I/C90Y/---→R91/---→A92/---→D93/I92→Y95/Y93→F96/I94→E97/D95→A98/S96→H99/N97→E100/R98→Y101/A99→N102/K125→Q128/ | 954 | 955 |

TABLE 5A-continued

CVS variants swaps

| Mut. No. | Mutation(s) | SEQ ID NO aa | SEQ ID NO nt |
|---|---|---|---|
| | K173→Q176/L175→---/V176→---/Q178→A179/D179→P180/V181→L182/T182→K183/P183→S184/K184→P185/F209→I210/M212→R213/N214→D215/H219→D220/Y221→V222/E238→D239/K252→Q253/P281→S282/Q292→K293/L313→C314/S314→T315/L315→M316/T317→S318/Q321→A322/E333→D334/K336→R337/L337→I338/A345→T346/G357→R358/N369→I370/S377→Y378/T405→R406/N429→G430/A436→S437/E484→D485/K499→E500/T501→P502/D536→E537 | | |
| V294 | S2C/S3M/G4T/E5G/T6E/F7S/R19K/K24Q/Q38N/T53L/D54A/A55T/E56G/D57R/V60I/A85M/I86L/Q87D/K88H/L89I/C90Y/---→R91/---→A92/---→D93/I92→Y95/Y93→F96/I94→E97/D95→A98/S96→H99/N97→E100/R98→Y101/A99→N102/K125→Q128/K173→Q176/L175→---/V176→---/Q178→A179/D179→P180/V181→L182/T182→K183/P183→S184/K184→P185/F209→I210/M212→S213/N214→Y215/S215→D216/T216→K217/S217→---/D218E/H219Q/L220S/Y221K/E238D/K252Q/P281S/Q292K/L313C/S314T/L315M/T317S/Q321A/E333D/K336R/L337I/A345T/G357R/N369I/S377Y/T405R/N429G/A436S/E484D/T501P/D536E | 956 | 957 |
| V295 | S2K/S3E/G4C/E5T/T6M/F7L/R19K/K24Q/Q38N/T53L/D54A/A55T/E56G/D57R/V60I/A85M/I86L/Q87D/K88H/L89I/C90Y/---→R91/---→A92/---→D93/I92→Y95/Y93→F96/I94→E97/D95→A98/S96→H99/N97→E100/R98→Y101/A99→N102/K125→Q128/K173→Q176/L175→---/V176→---/Q178→A179/D179→P180/V181→L182/T182→K183/P183→S184/K184→P185/F209→I210/M212→S213/N214→Y215/S215→D216/T216→K217/S217→---/D218E/H219Q/L220S/Y221K/E238D/K252Q/P281S/Q292K/L313C/S314T/L315M/T317S/Q321A/E333D/K336R/L337I/A345T/G357R/N369I/S377Y/T405R/N429G/A436S/E484D/T501P/D536E | 958 | 959 |
| V296 | S2K/S3E/G4C/E5T/T6M/F7L/R19K/K24Q/Q38N/T53L/D54A/A55T/E56G/D57R/V60I/A85M/I86L/Q87D/K88H/L89I/C90Y/---→R91/---→A92/---→D93/I92→Y95/Y93→F96/I94→E97/D95→A98/S96→H99/N97→E100/R98→Y101/A99→N102/K125→Q128/K173→Q176/L175→---/V176→---/Q178→A179/D179→P180/V181→L182/T182→K183/P183→S184/K184→P185/F209→I210/M212→S213/N214→Y215/S215→D216/T216→K217/S217→---/D218E/H219Q/L220S/Y221K/E238D/K252Q/P281S/Q292K/L313C/S314T/L315M/T317S/Q321A/E333D/K336R/L337I/A345T/G357R/N369I/S377Y/T405R/N429G/A436S/E484D/T501P/D536E | 960 | 961 |
| V297 | R19K/K24Q/Q38N/T53L/D54A/A55T/E56G/D57R/V60I/A85M/I86L/Q87D/K88H/L89I/C90Y/---→R91/---→A92/---→D93/I92→Y95/Y93→F96/I94→E97/D95→A98/S96→H99/N97→E100/R98→Y101/A99→N102/I116→Y119/K117→T120/V122→I125/E124→N127/K127→T130/D129→E132/E130→R133/S135→E138/S136→A139/N139→S142/Q142→R145/S146→G149/K173→Q176/L175→---/V176→---/Q178→A179/D179→P180/V181→L182/T182→K183/P183→S184/K184→P185/F209→I210/M212→R213/N214→D215/H219→D220/Y221→V222/E238→D239/K252→Q253/P281→S282/Q292→K293/L313→C314/S314→T315/L315→M316/T317→S318/Q321→A322/E333→D334/K336→R337/L337→I338/A345→T346/G357→R358/N369→I370/S377→Y378/T405→R406/N429→G430/A436→S437/E484→D485/T501→P502/D536→E537 | 962 | 963 |
| V298 | S2K/S3E/G4C/E5T/T6M/F7L/R19K/K24Q/Q38N/T53L/D54A/A55T/E56G/D57R/V60I/A85M/I86L/Q87D/K88H/L89I/C90Y/---→R91/---→A92/---→D93/I92→Y95/Y93→F96/I94→E97/D95→A98/S96→H99/N97→E100/R98→Y101/A99→N102/K125→Q128/K173→Q176/L175→---/V176→---/Q178→A179/D179→P180/V181→L182/T182→K183/P183→S184/K184→P185/F209→I210/M212→S213/N214→Y215/S215→D216/T216→K217/S217→---/D218E/H219Q/L220S/Y221K/E238D/K252Q/P281S/Q292K/L313C/S314T/L315M/T317S/Q321A/E333D/K336R/L337I/A345T/G357R/N369I/S377Y/T405R/N429G/A436S/E484D/T501P/D536E | 964 | 965 |
| V299 | A11T/R19K/K24Q/Q38N/T53L/D54A/A55T/E56G/D57R/V60I/A85M/I86L/Q87D/K88H/L89I/C90Y/---→R91/---→A92/---→D93/I92→Y95/Y93→F96/I94→E97/D95→A98/S96→H99/N97→E100/R98→Y101/A99→N102/K125→Q128/K173→Q176/L175→---/V176→---/Q178→A179/D179→P180/V181→L182/T182→K183/P183→S184/K184→P185/F209→I210/M212→R213/N214→D215/H219→D220/Y221→V222/E238→D239/K252→Q253/P281→S282/Q292→K293/L313→C314/S314→T315/L315→M316/T317→S318/ | 966 | 967 |

TABLE 5A-continued

CVS variants swaps

| Mut. No. | Mutation(s) | SEQ ID NO aa | SEQ ID NO nt |
|---|---|---|---|
| | Q321→A322/E333→D334/K336→R337/L337→I338/A345→T346/G357→R358/N369→I370/S377→Y378/T405→R406/N429→G430/A436→S437/E484→D485/T501→P502/D536→E537 | | |
| V300 | M1T/R19K/K24Q/Q38N/T53L/D54A/A55T/E56G/D57R/V60I/A85M/I86L/Q87D/K88H/L89I/C90Y/---→R91/---→A92/---→D93/I92→Y95/Y93→F96/I94→E97/D95→A98/S96→H99/N97→E100/R98→Y101/A99→N102/K125→Q128/Y152→H155/K173→Q176/L175→---/V176→---/Q178→A179/D179→P180/V181→L182/T182→K183/P183→S184/K184→P185/F209→I210/M212→R213/N214→D215/H219→D220/Y221→V222/E238→D239/K252→Q253/P281→S282/Q292→K293/L313→C314/S314→T315/L315→M316/T317→S318/Q321→A322/E333→D334/K336→R337/L337→I338/A345→T346/G357→R358/C361→R362/N369→I370/S377→Y378/T405→R406/N429→G430/A436→S437/K468→Q469/E484→D485/T501→P502/D536→E537 | 968 | 969 |
| V301 | S2C/S3M/G4T/E5G/T6E/F7S/R19K/K24Q/Q38N/T53L/D54A/A55T/E56G/D57R/V60I/A85M/I86L/Q87D/K88H/L89I/C90Y/---→R91/---→A92/---→D93/I92→Y95/Y93→F96/I94→E97/D95→A98/S96→H99/N97→E100/R98→Y101/A99→N102/K125→Q128/K173→Q176/L175→---/V176→---/Q178→A179/D179→P180/V181→L182/T182→K183/P183→S184/K184→P185/F209→I210/M212→S213/N214→Y215/S215→D216/T216→K217/S217→---/D218E/H219Q/L220S/Y221K/E238D/K252Q/P281S/Q292K/L313C/S314T/L315M/T317S/Q321A/E333D/K336R/L337I/A345T/G357R/N369I/S377Y/T405R/N429G/A436S/E484D/T501P/D536E | 970 | 971 |
| V302 | S2C/S3M/G4T/E5G/T6E/F7S/R19K/K24Q/Q38N/T53L/D54A/A55T/E56G/D57R/V60I/A85M/I86L/Q87D/K88H/L89I/C90Y/---→R91/---→A92/---→D93/I92→Y95/Y93→F96/I94→E97/D95→A98/S96→H99/N97→E100/R98→Y101/A99→N102/K125→Q128/K173→Q176/L175→---/V176→---/Q178→A179/D179→P180/V181→L182/T182→K183/P183→S184/K184→P185/F209→I210/M212→S213/N214→Y215/S215→D216/T216→K217/S217→---/D218E/H219Q/L220S/Y221K/E238D/K252Q/P281S/Q292K/L313C/S314T/L315M/T317S/Q321A/E333D/K336R/L337I/A345T/G357R/N369I/S377Y/T405R/N429G/A436S/E484D/T501P/D536E | 972 | 973 |
| V303 | S2K/S3E/G4C/E5T/T6M/F7L/R19K/K24Q/Q38N/T53L/D54A/A55T/E56G/D57R/V60I/A85M/I86L/Q87D/K88H/L89I/C90Y/---→R91/---→A92/---→D93/I92→Y95/Y93→F96/I94→E97/D95→A98/S96→H99/N97→E100/R98→Y101/A99→N102/K125→Q128/K173→Q176/L175→---/V176→---/Q178→A179/D179→P180/V181→L182/T182→K183/P183→S184/K184→P185/T200→Q201/F209→I210/M212→S213/N214→Y215/S215→D216/T216→K217/S217→---/D218E/H219Q/L220S/Y221K/E238D/K252Q/P281S/Q292K/L313C/S314T/L315M/T317S/Q321A/E333D/K336R/L337I/A345T/G357R/N369I/S377Y/T405R/N429G/A436S/E484D/T501P/D536E | 974 | 975 |
| V304 | R19K/K24Q/Q38N/T53L/D54A/A55T/E56G/D57R/V60I/A85M/I86L/Q87D/K88H/L89I/C90Y/---→R91/---→A92/---→D93/I92→Y95/Y93→F96/I94→E97/D95→A98/S96→H99/N97→E100/R98→Y101/A99→N102/K125→Q128/K173→Q176/L175→---/V176→---/Q178→A179/D179→P180/V181→L182/T182→K183/P183→S184/K184→P185/F209→I210/M212→R213/N214→D215/H219→D220/Y221→V222/E238→D239/K252→Q253/P281→S282/Q292→K293/L313→C314/S314→T315/L315→M316/T317→S318/Q321→A322/E333→D334/K336→R337/L337→I338/A345→T346/G357→R358/N369→I370/S377→Y378/T405→R406/N429→G430/A436→S437/Q448→L449/E484→D485/T501→P502/D536→E537 | 976 | 977 |
| V305 | R19K/K24Q/Q38N/T53L/D54A/A55T/E56G/D57R/V60I/A85M/I86L/Q87D/K88H/L89I/C90Y/---→R91/---→A92/---→D93/I92→Y95/Y93→F96/I94→E97/D95→A98/S96→H99/N97→E100/R98→Y101/A99→N102/K125→Q128/E163→D166/K173→Q176/L175→---/V176→---/Q178→A179/D179→P180/V181→L182/T182→K183/P183→S184/K184→P185/F209→I210/M212→R213/N214→D215/H219→D220/Y221→V222/E238→D239/K252→Q253/P281→S282/Q292→K293/L313→C314/S314→T315/L315→M316/T317→S318/Q321→A322/E333→D334/K336→R337/L337→I338/A345→T346/G357→R358/N369→I370/S377→Y378/T405→R406/N429→G430/A436→S437/Q448→L449/E484→D485/T501→P502/D536→E537 | 978 | 979 |
| V306 | R19K/K24Q/Q38N/T53L/D54A/A55T/E56G/D57R/V60I/A85M/I86L/Q87D/K88H/L89I/C90Y/---→R91/---→A92/---→D93/ | 980 | 981 |

TABLE 5A-continued

CVS variants swaps

| Mut. No. | Mutation(s) | SEQ ID NO aa | SEQ ID NO nt |
| --- | --- | --- | --- |
| | I92→Y95/Y93→F96/I94→E97/D95→A98/S96→H99/N97→E100/R98→Y101/A99→N102/K125→Q128/K173→Q176/L175→---/V176→---/Q178→A179/D179→P180/V181→L182/T182→K183/P183→S184/K184→P185/F209→I210/M210→T211/M212→R213/N214→D215/H219→D220/Y221→V222/E238→D239/K252→Q253/P281→S282/Q292→K293/L313→C314/S314→T315/L315→M316/T317→S318/Q321→A322/E333→D334/K336→R337/L337→I338/A345→T346/G357→R358/N369→I370/S377→Y378/T405→R406/N429→G430/A436→S437/E484→D485/P500→L501/T501→P502/D536→E537 | | |
| V307 | R19K/K24Q/Q38N/T53L/D54A/A55T/E56G/D57R/V60I/A85M/I86L/Q87D/K88H/L89I/C90Y/---→R91/---→A92/---→D93/I92→Y95/Y93→F96/I94→E97/D95→A98/S96→H99/N97→E100/R98→Y101/A99→N102/K125→Q128/K173→Q176/L175→---/V176→---/Q178→A179/D179→P180/V181→L182/T182→K183/P183→S184/K184→P185/F209→I210/M212→R213/N214→D215/H219→D220/Y221→V222/E238→D239/K252→Q253/P281→S282/Q292→K293/L313→C314/S314→T315/L315→M316/T317→S318/Q321→A322/E333→D334/K336→R337/L337→I338/A345→T346/G357→R358/N369→I370/S377→Y378/T405→R406/N429→G430/A436→S437/E484→D485/T501→P502/D536→E537 | 982 | 983 |
| V308 | R19K/N20D/L23S/K24Q/Q38N/T53L/D54A/A55T/E56G/D57R/V60I/A85M/I86L/Q87D/K88H/L89I/C90Y/---→R91/---→A92/---→D93/I92→Y95/Y93→F96/I94→E97/D95→A98/S96→H99/N97→E100/R98→Y101/A99→N102/K125→Q128/K173→E176/L175→---/V176→---/Q178→A179/D179→P180/V181→L182/T182→K183/P183→S184/K184→P185/F209→I210/M212→R213/N214→D215/H219→D220/Y221→V222/E238→D239/K252→Q253/P281→S282/Q292→K293/L313→C314/S314→T315/L315→M316/T317→S318/Q321→A322/E333→D334/K336→R337/L337→I338/A345→T346/G357→R358/N369→I370/S377→Y378/T405→R406/N429→G430/A436→S437/C465→S466/E484→D485/T501→P502/D536→E537/A539→V540 | 984 | 985 |
| V309 | S2C/S3M/G4T/E5G/T6E/F7S/R19K/K24Q/Q38N/T53L/D54A/A55T/E56G/D57R/V60I/A85M/I86L/Q87D/K88H/L89I/C90Y/---→R91/---→A92/---→D93/I92→Y95/Y93→F96/I94→E97/D95→A98/S96→H99/N97→E100/R98→Y101/A99→N102/K125→Q128/K173→Q176/L175→---/V176→---/Q178→A179/D179→P180/V181→L182/T182→K183/P183→S184/K184→P185/F209→I210/M212→S213/N214→Y215/S215→D216/T216→K217/S217→---/D218E/H219Q/L220S/Y221K/E238D/K252Q/P281S/Q292K/L313C/S314T/L315M/T317S/Q321A/E333D/K336R/L337I/A345T/E348A/G357R/N369I/S377Y/T405R/N429G/A436S/E484D/T501P/D536E | 986 | 987 |
| V310 | S2C/S3M/G4T/E5G/T6E/F7S/R19K/K24Q/Q38N/T53L/D54A/A55T/E56G/D57R/V60I/A85M/I86L/Q87D/K88H/L89I/C90Y/---→R91/---→A92/---→D93/I92→Y95/Y93→F96/I94→E97/D95→A98/S96→H99/N97→E100/R98→Y101/A99→N102/K125→Q128/K173→Q176/L175→---/V176→---/Q178→A179/D179→P180/V181→L182/T182→K183/P183→S184/K184→P185/F209→I210/M212→S213/N214→Y215/S215→D216/T216→K217/S217→---/D218E/H219Q/L220S/Y221K/E238D/K252Q/P281S/Q292K/L313C/S314T/L315M/T317S/Q321A/E333D/K336R/L337I/A345T/E348S/G357R/N369I/S377Y/T405R/N429G/A436S/E484D/T501P/D536E/ | 988 | 989 |
| V311 | K24Q/Q38N/K58Q/V60I/K88Q/P91N/I92S/Y93F/I94H/S96C/R98D/A99M/---→G101/---→D102/K125→Q127/K173→Q175/K184→R186/F209→I211/M212→R214/N214→D216/H219→D221/Y221→V223/E238→D240/K252→Q254/Q292→K294/Q321→A323/E333→D335/A345→T347/N369→I371/S377→Y379/T405→R407/N429→G431/A436→S438/T501→P503/D536→E538 | 990 | 991 |
| V312 | K24Q/Q38N/K58Q/V60I/I82V/K88Q/P91N/I92S/Y93F/I94H/S96C/R98D/A99M/---→G101/---→D102/K125→Q127/K173→Q175/K184→R186/F209→I211/M212→R214/N214→D216/H219→D221/Y221→V223/E238→D240/K252→Q254/Q292→K294/Q321→A323/E333→D335/A345→T347/N369→I371/S377→Y379/L399→S401/T405→R407/N429→G431/A436→S438/T501→P503/D536→E538 | 992 | 993 |
| V313 | S3T/G4Q/E5V/---→S6/---→A7/---→S8/---→S9/---→L10/---→A11/---→Q12/---→I13/---→P14/---→Q15/---→P16/T6→K17/F7→N18/T10→V21/D12→N23/S16→N27/L17→I28/R19→G30/N20→D31/H21→Q32/L23→I34/K24→T35/G25→Y36/A26→T37/S27→P38/D28→E39/F29→D40/T31→---/D33→T43/H34→R44/T35→A45/A36→C46/T37→K47/Q38→E48/R40→Q50/H41→I51/V48→I58/ | 994 | 995 |

TABLE 5A-continued

CVS variants swaps

| Mut. No. | Mutation(s) | SEQ ID NO aa | SEQ ID NO nt |
|---|---|---|---|
| | T53→L63/D54→A64/A55→T65/E56→G66/D57→R67/V60→I70/I86→L96/K88→H98/L89→I99/P91→N101/I92→S102/Y93→F103/I94→H104/S96→C106/R98→D108/A99→M109/---→G111/---→D112/H102→Y114/I116→Y128/K117→T129/V122→I134/E124→N136/K127→T139/D129→E141/E130→R142/S135→E147/S136→A148/N139→S151/Q142→R154/S146→G158/K173→Q185/L175→---/V176→---/Q178→A188/D179→P189/V181→L191/T182→K192/P183→S193/K184→P194/F209→I219/M212→V222/I213→Y223/N214→---/S215→---/T216→Q224/S217→D225/D218→E226/H219→A227/L220→F228/Y221→H229/E238→D246/K252→Q260/P281→S289/Q292→K300/L313→C321/S314→T322/L315→M323/T317→S325/Q321→A329/E333→D341/K336→R344/L337→I345/A345→T353/G357→R365/N369→I377/S377→Y385/T405→R413/N429→G437/A436→S444/E484→D492/T501→P509/D536→E544 | | |
| V314 | S3T/G4Q/E5V/---→S6/---→A7/---→S8/---→S9/---→L10/---→A11/---→Q12/---→I13/---→P14/---→Q15/---→P16/T6→K17/F7→N18/T10→V21/D12→N23/S16→N27/L17→I28/R19→G30/N20→D31/H21→Q32/L23→I34/K24→T35/G25→Y36/A26→T37/S27→P38/D28→E39/F29→D40/T31→---/D33→T43/H34→R44/T35→A45/A36→C46/T37→K47/Q38→E48/R40→Q50/H41→I51/T53→L63/D54→A64/A55→T65/E56→G66/D57→R67/V60→I70/I86→L96/K88→H98/L89→I99/P91→N101/I92→S102/Y93→F103/I94→H104/S96→C106/R98→D108/A99→M109/---→G111/---→D112/K125→Q137/K173→Q185/L175→---/V176→---/Q178→A188/D179→P189/V181→L191/T182→K192/P183→S193/K184→P194/F209→I219/M212→V222/I213→Y223/N214→---/S215→---/T216→Q224/S217→D225/D218→E226/H219→A227/L220→F228/Y221→H229/E238→D246/K252→Q260/P281→S289/Q292→K300/L313→C321/S314→T322/L315→M323/T317→S325/Q321→A329/E333→D341/K336→R344/L337→I345/A345→T353/G357→R365/N369→I377/S377→Y385/T405→R413/N429→G437/A436→S444/E484→D492/T501→P509/D536→E544 | 996 | 997 |
| V315 | S3T/G4Q/E5V/---→S6/---→A7/---→S8/---→S9/---→L10/---→A11/---→Q12/---→I13/---→P14/---→Q15/---→P16/T6→K17/F7→N18/T10→V21/D12→N23/S16→N27/L17→I28/R19→G30/N20→D31/H21→Q32/L23→I34/K24→T35/G25→Y36/A26→T37/S27→P38/D28→E39/F29→D40/T31→---/D33→T43/H34→R44/T35→A45/A36→C46/T37→K47/Q38→E48/R40→Q50/H41→I51/T53→L63/D54→A64/A55→T65/E56→G66/D57→R67/V60→I70/A85→M95/I86→L96/Q87→D97/K88→H98/L89→I99/C90→Y100/---→R101/---→A102/---→D103/I92→Y105/Y93→F106/I94→E107/D95→A108/S96→H109/N97→E110/R98→Y111/A99→N112/K125→Q138/K173→Q186/L175→---/V176→---/Q178→A189/D179→P190/V181→L192/T182→K193/P183→S194/K184→P195/F209→I220/M212→V223/I213→Y224/N214→---/S215→---/T216→Q225/S217→D226/D218→E227/H219→A228/L220→F229/Y221→H230/E238→D247/K252→Q261/P281→S290/Q292→K301/L313→C322/S314→T323/L315→M324/T317→S326/Q321→A330/E333→D342/K336→R345/L337→I346/A345→T354/G357→R366/N369→I378/S377→Y386/T405→R414/N429→G438/A436→S445/E484→D493/T501→P510/D536→E545 | 998 | 999 |

3. Product Distribution Mutants

Alternatively or in addition to effecting increased valencene production as described above, modified valencene synthase polypeptides provided herein can exhibit other altered properties. For example, provided herein are modified valencene synthase polypeptides that exhibit altered substrate specificity and/or product selectivity, and/or altered product distribution (i.e. altered relative amounts and/or types of terpenes) compared to wild-type valencene synthase set forth in SEQ ID NO:2. In other examples, provided herein are modified valencene synthase polypeptides that exhibit altered substrate specificity and/or product selectivity and/or altered product distribution (i.e. altered relative amounts and/or types of terpenes) compared to variant valencene synthase polypeptides set forth in SEQ ID NO:3 (V18) or SEQ ID NO:4 (V19). Such modified valencene synthase polypeptides can be used in methods to improve the production and/or generation of valencene, for example, by increasing the product distribution of valencene compared to other terpene products. This can result in methods that result in increased or improved purity of a valencene composition, increased or improved recovery of valencene from reaction medium and/or ease of methods to isolate valencene. Also, this can result in methods that also result in increased recovery of nootkatone by oxidation of the valencene.

For example, provided herein are modified valencene synthase polypeptides that produce decreased β-elemene as a percentage of total terpenes compared to β-elemene produced as a percentage of total terpenes by a valencene synthase polypeptide set forth in SEQ ID NO:2, 3 or 4. β-elemene is a degradation product of germacrene A, and is the measure of germacrene A produced. Hence, also provided herein are modified valencene synthase polypeptides that produce decreased germacrene A as a percentage of total terpenes compared to germacrene A produced as a percentage of total terpenes by a valencene synthase polypeptide set forth in SEQ ID NO:2, 3 or 4. For example, modified valencene synthase polypeptides provided herein produce 95%, 80%, 70%, 60%, 50%, 40%, 30%, 20%, 10% or less levels of β-elemene, and hence germacrene A, than is produced by wildtype valencene synthase set forth in SEQ ID NO:2. The percentage of β-elemene, and hence germacrene A, as a percentage of total terpene product produced can be decreased by greater than or about or 0.01% to 90%, such as 1% to 80%, 5% to 80%, 10% to 60% or 0.01% to 20%. For example, the percentage of terpene β-elemene product, and hence germacrene A, as a percentage of total terpene is decreased by at least or at least about 0.5%, 1%, 2%, 3%, 4%, 5%, 6%, 7%, 8%, 9%, 10%, 20%, 30%, 40%, 50%, 60%, 70%, 80%, 90% or more. Modified valencene synthases provided herein result in increased or improved production of valencene as a percentage of total terpenes produced in a reaction compared to wildtype valencene synthase set forth in SEQ ID NO:2. The percentage of valencene produced or recovered by weight is greater than 68%, for example, greater than or at least 70%, 71%, 72%, 73%, 74%, 75%, 76%, 77%, 78%, 79%, 80% or more.

Exemplary of such modified valencene polypeptides are polypeptides containing an amino acid modification at a position corresponding to residue 281, 313, 314, 315, 317, 336, 337 and/or 357 by CVS numbering with reference to positions set forth in SEQ ID NO:2. For example, amino acid replacements can be a replacement at any of the above positions that is P281S, P281H, P281K, P281A, P281W, P281L, P281Y, L313C, S314T, L315M, T317S, K336R, L337I, N347L and/or G357R. Exemplary amino acid substitution(s) or replacement(s) correspond to P281S, L313C, S314T, L315M, T317S, K336R, L337I, N347L and/or G357R by CVS numbering with reference to positions set forth in SEQ ID NO:2. For example, a modified valencene synthase polypeptide provided herein that exhibits reduced or decreased β-elemene formation contains amino acid substitutions (replacements) corresponding to P281S, L313C, S314T, L315M, T317S, K336R, L337I and G357R by CVS numbering with reference to positions set forth in SEQ ID NO:2. In some examples, a modified valencene synthase polypeptide provided herein that exhibits reduced or decreased β-elemene formation contains amino acid substitutions (replacements) corresponding to P281S, L313C, S314T, L315M, T317S, K336R, L337I, N347L and G357R by CVS numbering with reference to positions set forth in SEQ ID NO:2. It is understood that further or additional amino acid modifications can be included so long as the modified valencene synthase polypeptide exhibits altered product distribution.

For example, exemplary valencene synthase polypeptides that exhibit altered product distributions and decreased β-elemene formation include those set forth below. Hence, the exemplary valencene synthase polypeptides also produce less germacrene A. For example:

K24Q/Q38N/K58Q/V60I/K88Q/Y93H/N97D/R98K/K125Q/K173Q/K184R/F209I/M212R/N214D/H219D/Y221V/E238D/K252Q/P281S/Q292K/L313C/S314T/L315M/T317S/Q321A/E333D/K336R/A345T/N347L G357R/N369I/S377Y/T405R/N429G/A436S/T501P/D536E;

K24Q/Q38N/K58Q/V60I/K88Q/Y93H/N97D/R98K/K125Q/K173Q/K184R/F209I/M212R/N214D/H219D/Y221V/E238D/K252Q/P281S/Q292K/L313C/S314T/L315M/T317S/Q321A/E333D/K336R/L337I/A345T/N347L/G357R/N369I/S377Y/T405R/N429G/A436S/T501P/D536E;

K24Q/Q38N/K58Q/V60I/K88Q/Y93H/N97D/R98K/K125Q/K173Q/K184R/F209I/M212R/N214D/H219D/Y221V/E238D/K252Q/P281S/Q292K/L313C/S314T/L315M/T317S/Q321A/E333D/K336R/L337I/A345T/G357R/N369I/S377Y/T405R/N429G/A436S/T501P/D536E

K24Q/Q38N/T53L/D54A/A55T/E56G/D57R/V60I/K88Q/Y93H/N97D/R98K/K125Q/K173Q/K184R/F209I/M212R/N214D/H219D/Y221V/E238D/K252Q/P281S/Q292K/L313C/S314T/L315M/T317S/Q321A/E333D/K336R/L337I/A345T/N347L/G357R/N369I/S377Y/T405R/N429G/A436S/T501P/D536E;

K24Q/Q38N/T53L/D54A/A55T/E56G/D57R/V60I/K88Q/Y93H/N97D/R98K/K125Q/K173Q/K184R/F209I/M212R/N214D/H219D/Y221V/E238D/K252Q/P281S/Q292K/L313C/S314T/L315M/T317S/Q321A/E333D/K336R/L337I/A345T/G357R/N369I/S377Y/T405R/N429G/A436S/T501P/D536E;

R19K/K24Q/Q38N/T53L/D54A/A55T/E56G/D57R/V60I/A85M/I86L/Q87D/K88H/L89I/C90Y/---→R91/---→A92/---→D93/I92→Y95/Y93→F96/I94→E97/D95→A98/S96→H99/N97→E100/R98→Y101/A99→N102/K125→Q128/K173→Q176/L175→---/V176→---/Q178→A179/D179→P180N181→L182/T182→K183/P183-S184/K184→P185/F209→I210/M212→R213/N214→D215/H219→D220/Y221→V222/E238→D239/K252→Q253/P281→S282/Q292→K293/L313→C314/S314→T315/L315→M316/T317→S318/Q321→A322/E333→D334/K336→R337/L337→I338/A345→T346/G357→R358/N369→I370/S377→Y378/T405→R406/N429→G430/A436→S437/E484→D485/T501→P502/D536→E537; and/or S3T/G4Q/E5V/---→S6/---→A7/---→S8/---→S9/---→L10/---→A11/---→I13/---→P14/---→Q15/---→P16/T6→K17/F7→N18/T10→V21/D12→N23/S16→N27/L17→I28/R19→G30/N20→D31/H21→Q32/L23→I34/K24→T35/G25→Y36/A26→T37/S27→P38/D28→E39/F29→D40/T31→---/D33→T43/H34→R44/T35→G45/A36→C46/T37→K47/Q38→E48/R40→Q50/H41→I51/T53→L63/D54→A64/A55→T65/E56→G66/D57→R67/V60→I70/A85→M95/I86→L96/Q87→D97/K88→H98/L89→I99/C90→Y100/---→R101/---→A102/---→D103/I92→Y105/Y93→F106/I94→E107/D95→A108/S96→H109/N97→E110/R98→Y111/A99→N112/K125→Q138/K173→Q186/L175→---/V176→---/Q178→A189/D179→P190/V181→L192/T182→K193/P183→S194/K184→P195/F209→I220/M212→V223/I213→Y224/N214→---/S215→---/T216→Q225/S217→D226/D218→E227/H219→A228/L220→F229/Y221→H230/E238→D247/K252→Q261/P281→S290/Q292→K301/L313→C322/S314→T323/L315→M324/T317→S326/Q321→A330/E333→D342/K336→R345/L337→I346/A345→T354/G357→R366/N369→I378/S377→Y386/T405→R414/N429→G438/A436-S445/E484→D493/T501→P510/D536→E545.

Exemplary of such polypeptides include any set forth in SEQ ID NO:5, 61, 63, 350, 351, 744 or 887 or encoded by a sequence of nucleic acids set forth in any of SEQ ID NOS: 130, 197, 198, 352, 353, 714 or 891, or degenerate codons thereof.

D. Methods for Producing Modified Terpene Synthases and Encoding Nucleic Acid Molecules Provided are methods for producing modified terpene synthase polypeptides. The methods can be used to generate terpene synthases with desired properties, including, but not limited to, increased terpene production upon reaction with an acyclic pyrophosphate terpene precursor, such as FPP, GPP or GGPP; altered product distribution; altered substrate specificity; and/or altered regioselectivity and/or stereoselectivity. Modified terpene synthases can be produced using any method known in the art and, optionally, screened for the desired properties. In particular examples, modified terpene synthases with desired properties are generated by mutation in accord with the methods exemplified herein. Thus, provided herein are modified terpene synthases and nucleic acid molecules encoding the modified terpene synthases that are produced using the methods described herein.

Exemplary of the methods provided herein are those in which modified terpene synthases are produced by replacing one or more endogenous domains or regions of a first terpene synthase with the corresponding domain(s) or regions(s) from a second terpene synthase (i.e. heterologous domains or regions). In further examples, two or more endogenous domains or regions of a first terpene synthase are replaced with the corresponding heterologous domain(s) or regions(s) from two or more other terpene synthases, such as a second, third, fourth, fifth, sixth, seventh, eighth, ninth, or tenth terpene synthase. Thus, the resulting modified terpene synthase can include heterologous domains or regions from 1, 2, 3, 4, 5, 6, 7, 8, 9 or more different terpene synthases. In further examples, the methods also or instead include replacing one or more domains or regions of a first terpene synthase with randomized amino acid residues.

Any terpene synthase can be used in the methods provided herein. The first terpene synthase (i.e. the terpene synthase to be modified) can be of the same or different class as the second (or third, fourth, fifth etc.) terpene synthase (i.e. the terpene synthase(s) from which the heterologous domain(s) or region(s) is derived). For example, included among the methods provided herein are those in which the terpene synthase to be modified is a monoterpene, diterpene or sesquiterpene synthase, and the terpene synthase(s) from which the one or more the heterologous domains or regions are derived is a monoterpene, diterpene or sesquiterpene synthase. In some examples, all of the terpene synthases used in the methods provided herein are sesquiterpene synthases. Exemplary sesquiterpene synthases include, but are not limited to, valencene synthase, TEAS, HPS, and santalene synthase. Exemplary terpene synthases that can be used in the methods herein, including exemplary amino acid and nucleic acid sequences thereof, include but are not limited to, any set forth in Table 5B.

TABLE 5B

| Synthase | Genbank Acc. No. | SEQ ID NO aa | SEQ ID NO nt |
|---|---|---|---|
| *Abies grandis* abietadiene cyclase | AAB05407 | 355 | 521 |
| *Abies grandis* E-α-bisabolene synthase | AAK83562 | 359 | 522 |
| *Abies grandis* pinene synthase | O24475 | 356 | 523 |
| *Abies grandis* γ-humulene synthase | AAC05728 | 358 | 524 |
| *Abies grandis* δ-selinene synthase | AAC05727 | 357 | 525 |
| *Actinidia deliciosa* germacrene-D synthase | AAX16121.1 | 354 | 526 |
| *Antirrhinum majus* (3S)-(E)-nerolidol synthase | ABR24417 | 418 | 527 |
| *Arabidopsis thaliana* (−)-E-β-caryophylene synthase | AAO85539 | 419 | 528 |
| *Arabidopsis thaliana* (E)-β-ocimene synthase/myrcene synthase | NP_567511 | 375 | 529 |
| *Arabidopsis thaliana* (Z)-γ-bisabolene synthase | NP_193064 | 420 | 530 |
| *Arabidopsis thaliana* (Z)-γ-bisabolene synthase | NP_193066 | 421 | 531 |
| *Arabidopsis thaliana* GA1 ent-copalyl diphosphate synthase/magnesium ion binding | NP_192187 | 369 | 532 |
| *Arabidopsis thaliana* myrcene/ocimene synthase | AAG09310 | 360 | 533 |
| *Arabidopsis thaliana* similar to Nicotiana 5-epi-aristolochene synthase | AAB61105 | 362 | 534 |
| *Arabidopsis thaliana* strong similarity to Nicotiana 5-epi-aristolochene synthase and *Gossypium hirsutum* δ cadinene synthase | AAC64880 | 361 | 535 |
| *Arabidopsis thaliana* terpene cyclase TC1 | CAA72070 | 363 | 536 |
| *Arabidopsis thaliana* terpene synthase/cyclase family protein | NP_174635 | 364 | 537 |
| *Arabidopsis thaliana* terpene synthase/cyclase family protein | NP_175312 | 365 | 538 |
| *Arabidopsis thaliana* terpene synthase/cyclase family protein | NP_188067 | 366 | 539 |
| *Arabidopsis thaliana* terpene synthase/cyclase family protein | NP_189746 | 367 | 540 |
| *Arabidopsis thaliana* terpene synthase/cyclase family protein | NP_193754 | 368 | 541 |
| *Arabidopsis thaliana* terpene synthase/cyclase family protein | NP_199276 | 370 | 542 |
| *Aribidopsis thaliana* beta-caryophyllene/alpha-humulene synthase | AAO85539 | 374 | 543 |
| *Aribidopsis thaliana* terpene synthase | AAO85535 | 371 | 544 |
| *Aribidopsis thaliana* terpene synthase | AAO85536 | 372 | 545 |
| *Aribidopsis thaliana* terpene synthase | AAO85537 | 373 | 546 |
| *Artemisia annua* (−)-beta-pinene synthase | AAK58723 | 379 | 547 |
| *Artemisia annua* (3R)-linalool synthase | AAF13357 | 382 | 548 |
| *Artemisia annua* (E)-beta-farnesene synthase | AAX39387 | 422 | 549 |
| *Artemisia annua* 8-epi-cedrol synthase | AAF80333 | 423 | 550 |
| *Artemisia annua* 8-epi-cedrol synthase | CAC08805 | 424 | 551 |
| *Artemisia annua* amorpha-4,11-diene synthase | AAK15696 | 381 | 552 |
| *Artemisia annua* (E)-beta-caryophyllene synthase | AAL79181 | 425 | 553 |
| *Artemisia annua* germacrene A synthase | ABE03980 | 383 | 554 |
| *Artemisia annua* putative sesquiterpene cyclase | CAB56499 | 376 | 555 |
| *Artemisia annua* putative sesquiterpene cyclase | CAC12731 | 377 | 556 |
| *Artemisia annua* putative sesquiterpene cyclase | CAC12732 | 378 | 557 |
| *Artemisia annua* sesquiterpene cyclase | AAG24640 | 380 | 558 |
| *Aspergillus terreus* aristolochene synthase | AAF13263 | 426 | 559 |

TABLE 5B-continued

| Synthase | Genbank Acc. No. | SEQ ID NO aa | SEQ ID NO nt |
|---|---|---|---|
| *Capsicum annuum* 5-epi-aristolochene synthase | CAA06614.1 | 385 | 560 |
| *Capsicum annuum* 5-epi-aristolochene synthase | AAC61260.1 | 384 | 561 |
| *Cichorium intybus* germacrene A synthase long form | AAM21658 | 387 | 562 |
| *Cichorium intybus* germacrene A synthase short form | AAM21659 | 386 | 563 |
| *Cinnamomum tenuipile* geraniol synthase | CAD29734 | 388 | 564 |
| *Cistus creticus* subsp. *Creticus* germacrene B synthase | ACF94469.1 | 389 | 565 |
| *Citrus junos* (E)-β-farnesene synthase | AAK54279 | 390 | 566 |
| *Citrus junos* terpene synthase | AAG01339 | 391 | 567 |
| *Citrus limon* (+)-limonene synthase 1 | AAM53944 | 393 | 568 |
| *Citrus limon* γ-terpinene synthase | AAM53943 | 392 | 569 |
| *Citrus sinensis* terpene synthase 1 | ACX70155.1 | 394 | 570 |
| *Citrus x paradisi* putative terpene synthase | AAM00426.1 | 395 | 571 |
| *Crepidiastrum sonochifolium* germacrene A synthase | ABB00361 | 396 | 572 |
| *Croton sublyratus* copalyl diphosphate synthase | BAA95612 | 397 | 573 |
| *Cucumis melo* δ-cadinene synthase | ABX83200 | 400 | 574 |
| *Cucumis melo* α-farnesene synthase | ABX83201 | 427 | 575 |
| *Cucumis sativus* (E,E)-α-caryophyllene synthase | AAU05952 | 428 | 576 |
| *Cucumis sativus* (E)-α-farnesene synthase | AAU05951 | 429 | 577 |
| *Cucurbita maxima* copalyl diphosphate synthase 2 | AAD04293 | 399 | 578 |
| *Cucurbita maxima* ent-kaurene synthase B | AAB39482 | 398 | 579 |
| *Elaeis oleifera* sesquiterpene synthase | AAC31570 | 401 | 580 |
| *Giberella fujikuroi* (−)-copalyl diphosphate/(−)-ent-kaurene synthase | Q9UVY5 | 430 | 581 |
| *Ginkgo biloba* levopimaradiene synthase | AAL09965 | 402 | 582 |
| *Gossypium arboreum* (+)-δ-cadinene synthase | CAA77191.1 | 403 | 583 |
| *Gossypium arboreum* (+)-δ-cadinene synthase | AAB41259.1 | 405 | 584 |
| *Gossypium arboreum* (+)-δ-cadinene synthase isozyme C2 | CAA76223.1 | 404 | 585 |
| *Gossypium arboreum* (+)-δ-cadinene synthase isozyme XC1 | Q39761 | 406 | 586 |
| *Gossypium arboreum* (+)-δ-cadinene synthase isozyme XC14 | AAA93065.1 | 407 | 587 |
| *Gossypium arboreum* (+)-α-cadinene synthase | AAA93064 | 431 | 588 |
| *Gossypium hirsutum* (+)-δ-cadinene synthase | AAC12784.1 | 408 | 589 |
| *Gossypium hirsutum* (+)-δ-cadinene synthase | AAX44033.1 | 409 | 590 |
| *Gossypium hirsutum* (+)-δ-cadinene synthase | AAF74977.1 | 410 | 591 |
| *Gossypium hirsutum* (+)-δ-cadinene synthase | AAX44034.1 | 411 | 592 |
| *Helianthus annuus* germacrene A synthase 1 | ACA14463 | 412 | 593 |
| *Helianthus annuus* germacrene A synthase 2 | ABY49939 | 413 | 594 |
| *Helianthus annuus* germacrene A synthase 3 | ACZ50512 | 414 | 595 |
| *Helianthus annuus* γ-cadinene synthase | AAY41422 | 415 | 596 |
| *Hyoscyamus muticus* premnaspirodiene synthase | AAA86337.1 | 296 | 597 |
| *Hyoscyamus muticus* premnaspirodiene synthase | AAA86340.1 | 942 | 943 |
| *Hyoscyamus muticus* vetispiradiene synthase | AAA86339.1 | 416 | 598 |
| *Ixeris dentate* germacrene A synthase | AAL92481 | 432 | 599 |
| *Kitasatospora griseola* diterpene cyclase-2 | BAB39207 | 417 | 600 |
| *Lactuca sativa* copalyldiphosphate synthase No. 1 | BAB12440 | 433 | 601 |
| *Lactuca sativa* germacrene A synthase LTC1 | AAM11626 | 433 | 602 |
| *Lactuca sativa* germacrene A synthase LTC2 | AAM11627 | 434 | 603 |
| *Lavandula angusivolia* (E)-α-bergamotene synthase | ABB73046 | 435 | 604 |
| *Lycopersicon esculentum* germacrene C synthase | AAC39432 | 436 | 605 |
| *Lycopersicon esculentum* δ-elemene synthase | AAG41889 | 437 | 606 |
| *Lycopersicon esculentum* δ-elemene synthase | AAG41890 | 438 | 607 |
| *Lycopersicon hirsutum* germacrene B synthase | AAG41891 | 439 | 608 |
| *Lycopersicon hirsutum* germacrene D synthase | AAG41892 | 440 | 609 |
| *Magnolia grandiflora* β-cubebene synthase | ACC66281 | 441 | 610 |
| *Malus x domestica* (E,E)-α-farnesene synthase | AAO22848 | 442 | 611 |
| *Medicago truncatula* (−)-cubebol synthase | ABB01625 | 443 | 612 |
| *Medicago truncatula* (E)-β-caryophyllene synthase | AAV36464 | 444 | 613 |
| *Medicago truncatula* 3S-(E)-nerolidol synthase | AAV36466 | 445 | 614 |
| *Mentha x pipereta* (Z)-muurola-3,5-diene synthase | CAH10288 | 446 | 615 |
| *Mentha x piperita* (E)-β-farnesene synthase | AAB95209 | 447 | 616 |
| *Mikania micrantha* β-caryophyllene synthase | ACN67535 | 448 | 617 |
| *Nicotiana attenuata* 5-epi-aristolochene synthase | AAO85555.1 | 449 | 618 |
| *Nicotiana tabacum* 5-epi-aristolochene synthase | L04680 AAA19216.1 | 295 | 619 |
| *Nicotiana tabacum* 5-epi-aristolochene synthase | GI:2624425 | 941 | 619 |
| *Ocimum basilicum* germacrene D synthase | AAV63786 | 451 | 620 |
| *Ocimum basilicum* α-zingiberene synthase | AAV63788 | 452 | 621 |
| *Ocimum basilicum* β-selinene synthase | AAV63785 | 453 | 622 |
| *Ocimum basilicum* δ-cadinene synthase | Q5SBP5 | 454 | 623 |
| *Oryza sativa* (E)-β-caryophyllene synthase | ACF05331 | 455 | 624 |
| *Oryza sativa* (E)-β-caryophyllene synthase | ABJ16553 | 456 | 625 |
| *Oryza sativa* (E,E)-farnesol synthase | ABJ16554 | 457 | 626 |
| *Oryza sativa* α-zingiberene synthase | ACF05529 | 458 | 627 |
| *Perilla frutescens* var. *frutescens* sesquiterpene synthase | AAX16076.1 | 459 | 628 |
| *Perilla frutescens* var. *frutescens* valencene synthase | AAX16077.1 | 460 | 629 |
| *Picea abies* (E)-α-bisabolene synthase | AAS47689 | 461 | 630 |
| *Picea abies* (E,E)-α-farnesene synthase | AAS47697 | 462 | 631 |

TABLE 5B-continued

| Synthase | Genbank Acc. No. | SEQ ID NO aa | SEQ ID NO nt |
|---|---|---|---|
| *Picea abies* longifolene synthase | AAS47695 | 463 | 632 |
| *Pinus taeda* (E,E)-α-farnesene synthase | AAO61226 | 464 | 633 |
| *Pisum sativum* ent-kaurene synthase A | AAB58822 | 465 | 634 |
| *Pogostemon cablin* (−)-germacrene D synthase | AAS86322 | 466 | 635 |
| *Pogostemon cablin* (−)-germacrene A synthase | AAS86320.1 | 467 | 636 |
| *Pogostemon cablin* (+)- germacrene A synthase | AAS86321.1 | 468 | 637 |
| *Pogostemon cablin* patchoulol synthase | AAS86323 | 469 | 638 |
| *Pogostemon cablin* γ-curcumene synthase | AAS86319 | 470 | 639 |
| *Populus balsamifera* ssp. *trichocarpa x Populus deltoides* (−)-germacrene D synthase | AAR99061.1 | 471 | 640 |
| *Pseudotsuga menziesii* (E)-β-farnesene synthase | AAX07265 | 472 | 641 |
| *Pseudotsuga menziesii* (E)-γ-bisabolene synthase | AAX07266 | 473 | 642 |
| *Ricinus communis* (+)-δ-cadinene synthase isozyme A | EEF38721.1 | 474 | 643 |
| *Ricinus communis* (+)-δ-cadinene synthase isozyme A | EEF38510.1 | 475 | 644 |
| *Ricinus communis* Casbene synthase | EEF48772.1 | 476 | 645 |
| *Ricinus communis* casbene synthase, chloroplastic | P59287 | 477 | 646 |
| *Salvea sclarea* labdenediol diphosphate synthase WO2009101126 | | 478 | 647 |
| *Salvea sclarea* labdenediol diphosphate synthase WO2009101126 | | 479 | 648 |
| *Salvea sclarea* sclareol synthase WO2009101126 | | 480 | 649 |
| *Santalum album* santalene synthase WO2009109597 | | 481 | 650 |
| *Santalum album* santalene synthase WO20100067309 | | 482 | 651 |
| *Santalum album* santalene synthase WO20100067309 | | 483 | 652 |
| *Santalum album* santalene synthase WO20100067309 | | 484 | 653 |
| *Santalum album* santalene synthase WO20100067309 | | 485 | 654 |
| *Santalum album* sesquiterpene synthase | ACF24768.1 | 486 | 655 |
| *Santalum austrocaledonicum* sesquiterpene synthase | ADO87005.1 | 487 | 656 |
| *Santalum spicatum* sesquiterpene synthase | ADO87006.1 | 488 | 657 |
| *Scoparia dulcis* copalyl diphosphate | BAD03594 | 489 | 658 |
| *Solanum habrochaites* sesquiterpene synthase 1 | AAG41891.1 | 490 | 659 |
| *Solanum habrochaites* sesquiterpene synthase 2 | AAG41892 | 491 | 660 |
| *Solanum lycopersicum* caryophyllene/alpha-humulene synthase | D5KXD2 | 492 | 661 |
| *Solanum lycopersicum* copalyl diphosphate synthase | BAA84918 | 493 | 662 |
| *Solanum lycopersicum* germacrene C synthase | AAC39432 | 494 | 663 |
| *Solanum lycopersicum* vetispiradiene synthase | AAG09949.1 | 495 | 664 |
| *Solanum tuberosum* putative vetispiradiene synthase 4 | AAD02269 | 496 | 665 |
| *Solanum tuberosum* vetispiradiene synthase | BAA82092.1 | 497 | 666 |
| *Solidago canadensis* germacrene A synthase | CAC36896 | 498 | 667 |
| *Solidago canadensis* germacrene D synthase | CAE47440 | 499 | 668 |
| *Stevia rebaudiana* (−)-copalyl diphosphate synthase | AAB87091 | 500 | 669 |
| *Stevia rebaudiana* (−)-ent-kaurene synthase | AAD34295 | 501 | 670 |
| *Stevia rebaudiana* kaurene synthase | AAD34294 | 502 | 671 |
| *Taxus wallilchiana* var. *chinensis* Taxadiene synthase | Q9FT37 | 503 | 672 |
| *Vitis vinifera* (−)-germacrene D synthase | AAS66357.1 | 504 | 673 |
| *Vitis vinifera* (+)-valencene synthase | ACO36239.1 | 505 | 674 |
| *Vitis vinifera* (+)-valencene synthase | AAS66358 | 346 | 675 |
| *Zea diploperennis* (E)-β-caryophyllene synthase | ABY79209 | 347 | 676 |
| *Zea luxurians* (E)-β-caryophyllene synthase | ABY79211 | 506 | 677 |
| *Zea m. huehuetenangensis* (E)-β-caryophyllene synthase | ABY79210 | 507 | 678 |
| *Zea mays* (−)-β-macrocarpene synthase | AAS88576 | 508 | 679 |
| *Zea mays* (−)-β-macrocarpene synthase | AAT70085 | 509 | 680 |
| *Zea mays* (−)-β-macrocarpene synthase | ACF58240 | 510 | 681 |
| *Zea mays* (E)-β-caryophyllene synthase | ABY79206 | 511 | 682 |
| *Zea mays* (E,E)-farnesol synthase | AAO18435 | 512 | 683 |
| *Zea mays* sesquithujene synthase | AAS88574 | 513 | 684 |
| *Zea mays* S-β-bisabolene synthase | AAS88571 | 514 | 685 |
| *Zea mays mexicana* (E)-β-caryophyllene synthase | ABY79212 | 515 | 686 |
| *Zea mays parviglumis* (E)-β-caryophyllene synthase | ABY79213 | 516 | 687 |
| *Zea perennis* (E)-β-caryophyllene synthase | ABY79214 | 517 | 688 |
| *Zingiber officinale* germacrene D synthase | AAX409665 | 518 | 689 |
| Zingiber *zerumbet* α-humulene synthase | BAG12020 | 519 | 690 |
| *Zingiber zerumbet* β-eudesmol synthase | BAG12021 | 520 | 691 |

In the methods provided herein, all or a contiguous portion of an endogenous domain of a first terpene synthase can be replaced with all or a contiguous portion of the corresponding heterologous domain from a second terpene synthase. For example, 3, 4, 5, 6, 7, 8, 9, 10 or more contiguous amino acids from a domain or region in a first synthase can be replaced with 3, 4, 5, 6, 7, 8, 9, 10 or more contiguous amino acids from the corresponding region from a second terpene synthase. In some examples, one or more amino acid residues adjacent to the endogenous domain of the first terpene synthase also are replaced, and/or one or more amino acid residues adjacent to the heterologous domain also are used in the replacement. Further, the methods provided herein also include methods in which all or a contiguous portion of a first domain and all or a contiguous portion of a second adjacent domain are replaced with the corresponding domains (or portions thereof) from another terpene synthase.

Domains or regions that can be replaced include functional domains or structural domains. Exemplary domains or regions that can be replaced in a terpene synthase using the methods described herein include, but are not limited to, structural domains or regions corresponding to unstructured loop 1 (corresponding to amino acids 1-29 of SEQ ID NO:2); alpha helix 1 (corresponding to amino acids 30-39 and 44-52 of SEQ ID NO:2); unstructured loop 2 (corresponding to amino acids 53-58 of SEQ ID NO:2); alpha helix 2 (corresponding to amino acids 59-71 of SEQ ID NO:2); unstructured loop 3 (corresponding to amino acids 72-78 of SEQ ID NO:2); alpha helix 3 (corresponding to amino acids 79-93 of SEQ ID NO:2); unstructured loop 4 (corresponding to amino acids 94-100 of SEQ ID NO:2); alpha helix 4 (corresponding to amino acids 101-114 of SEQ ID NO:2); unstructured loop 5 (corresponding to amino acids 115-141 of SEQ ID NO:2); alpha helix 5 (corresponding to amino acids 142-152 of SEQ ID NO:2); unstructured loop 6 (corresponding to amino acids 153-162 of SEQ ID NO:2); alpha helix 6 (corresponding to amino acids 163-173 of SEQ ID NO:2); unstructured loop 7 (corresponding to amino acids 174-184 of SEQ ID NO:2); alpha helix 7 (corresponding to amino acids 185-194 of SEQ ID NO:2); unstructured loop 8 (corresponding to amino acids 195-201 of SEQ ID NO:2); alpha helix 8 (corresponding to amino acids 202-212 of SEQ ID NO:2); unstructured loop 9 (corresponding to amino acids 213-222 of SEQ ID NO:2); alpha helix A (corresponding to amino acids 223-253 of SEQ ID NO:2); A-C loop (corresponding to amino acids 254-266 of SEQ ID NO:2); alpha helix C (corresponding to amino acids 267-276 of SEQ ID NO:2); unstructured loop 11 (corresponding to amino acids 277-283 of SEQ ID NO:2); alpha helix D (corresponding to amino acids 284-305 of SEQ ID NO:2); unstructured loop 12 (corresponding to amino acids 306-309 of SEQ ID NO:2); alpha helix D1 (corresponding to amino acids 310-322 of SEQ ID NO:2); unstructured loop 13 (corresponding to amino acids 323-328 of SEQ ID NO:2); alpha helix D2 (corresponding to amino acids 329 of SEQ ID NO:2); unstructured loop 14 (corresponding to amino acids 330-332 of SEQ ID NO:2); alpha helix E (corresponding to amino acids 333-351 of SEQ ID NO:2); unstructured loop 15 (corresponding to amino acids 352-362 of SEQ ID NO:2); alpha helix F (corresponding to amino acids 363-385 of SEQ ID NO:2); unstructured loop 16 (corresponding to amino acids 386-390 of SEQ ID NO:2); alpha helix G1 (corresponding to amino acids 391-395 of SEQ ID NO:2); unstructured loop 17 (corresponding to amino acids 396-404 of SEQ ID NO:2); alpha helix G2 (corresponding to amino acids 405-413 of SEQ ID NO:2); unstructured loop 18 (corresponding to amino acids 414-421 of SEQ ID NO:2); alpha helix H1 (corresponding to amino acids 422-428 of SEQ ID NO:2); unstructured loop 19 (corresponding to amino acids 429-431 of SEQ ID NO:2); alpha helix H2 (corresponding to amino acids 432-447 of SEQ ID NO:2); unstructured loop 20 (corresponding to amino acids 448-450 of SEQ ID NO:2); alpha helix H3 (corresponding to amino acids 451-455 of SEQ ID NO:2); unstructured loop 21 (corresponding to amino acids 456-461 of SEQ ID NO:2); alpha helix a-1 (corresponding to amino acids 462-470 of SEQ ID NO:2); unstructured loop 22 (corresponding to amino acids 471-473 of SEQ ID NO:2); alpha helix I (corresponding to amino acids 474-495 of SEQ ID NO:2); unstructured loop 23 (corresponding to amino acids 496-508 of SEQ ID NO:2); alpha helix J (corresponding to amino acids 509-521 of SEQ ID NO:2); J-K loop (corresponding to amino acids 522-534 of SEQ ID NO:2); alpha helix K (corresponding to amino acids 535-541 of SEQ ID NO:2); and unstructured loop 25 (corresponding to amino acids 542-548 of SEQ ID NO:2). Any one or more of these domains or regions, or a portion thereof, can be replaced with a corresponding domain from another terpene synthase using the methods provided herein. These domains are regions can be identified in any terpene synthase using methods well known in the art, such as, for example, by alignment using methods known to those of skill in the art (see, e.g, FIGS. 2A-C). Such methods typically maximize matches, and include methods such as using manual alignments and by using the numerous alignment programs available (for example, BLASTP) and others known to those of skill in the art. By aligning the sequences of the valencene synthase set forth in SEQ ID NO:2, and any other terpene synthase, any of the domains or regions recited above can be identified in any terpene synthase.

In some examples of the methods provided herein, a region corresponding to a portion of unstructured loop 1 and alpha helix 1 of valencene synthase (corresponding to amino acids 3-41 of SEQ ID NO:2) in a first terpene synthase is replaced with the corresponding region from a second terpene synthase; the region corresponding to unstructured loop 2 (corresponding to amino acids 53-58 of SEQ ID NO:2) in a first terpene synthase is replaced with the corresponding region from a second terpene synthase; the region corresponding to a portion of alpha helix 3 (corresponding to amino acids 85-89 of SEQ ID NO:2) in a first terpene synthase is replaced with the corresponding region in a second terpene synthase; the region corresponding to a portion of alpha helix 3 and unstructured loop 4 (corresponding to amino acids 85-99 of SEQ ID NO:2) in a first terpene synthase is replaced with the corresponding region from a second terpene synthase; the region corresponding to unstructured loop 6 and adjacent residues (corresponding to amino acids 152-163 of SEQ ID NO:2) in a first terpene synthase is replaced with the corresponding region from a second terpene synthase; the region corresponding to unstructured loop 7 (corresponding to amino acids 174-184 of SEQ ID NO:2) in a first terpene synthase is replaced with the corresponding region from a second terpene synthase; the region corresponding to unstructured loop 9 and an adjacent residue (corresponding to amino acids 212-221 of SEQ ID NO:2) in a first terpene synthase is replaced with the corresponding region from a second terpene synthase; the region corresponding to alpha helix D1 (corresponding to amino acids 310-322 of SEQ ID NO:2) in a first terpene synthase is replaced with the corresponding region from a second terpene synthase; and/or the region corresponding to the J-K loop (corresponding to amino acids 522-534 of SEQ ID NO:2) in a first terpene synthase is replaced with the corresponding region a second terpene synthase.

For example, provided herein are methods in which a portion of unstructured loop 1 and alpha helix 1 of valencene synthase (corresponding to amino acids 3-41 of SEQ ID NO:2) is replaced with amino acids 3-51 of the *Vitis vinifera* set forth in SEQ ID NO:346; the region corresponding to unstructured loop 2 (corresponding to amino acids 53-58 of SEQ ID NO:2) of a first terpene synthase is replaced with amino acids 58-63 of the TEAS polypeptide set forth in SEQ ID NO:295 or 941; the region corresponding to a portion of alpha helix 3 (corresponding to amino acids 85-89 of SEQ ID NO:2) is replaced with amino acid residues 93-97 of the HPS set forth in SEQ ID NO:942); the region corresponding to a portion of alpha helix 3 and unstructured loop 4 (corresponding to amino acids 85-99 of SEQ ID NO:2) of a first terpene synthase is replaced with amino acid residues 93-110 of the HPS set forth in SEQ ID NO:942; the region corresponding to unstructured loop 6 and adjacent residues (corresponding to amino acids 152-163 of SEQ ID NO:2) of a first terpene synthase is replaced with the amino acids 163-174 of the HPS set forth in SEQ ID NO:942; the region corresponding to unstructured loop 7 (corresponding to amino acids 174-184 of SEQ ID NO:2) of a first terpene synthase is replaced with the amino acids 185-193 of the HPS set forth in SEQ ID NO:942; the region corresponding to unstructured loop 9 and an adjacent residue (corresponding to amino acids 212-221 of SEQ ID NO:2) of a first terpene synthase is replaced with amino acids 221-228 of the BPS set forth in SEQ ID NO:942; the region corresponding to alpha helix D1 (corresponding to amino acids 310-322 of SEQ ID NO:2) of a first terpene synthase is replaced with amino acids 317-329 of the HPS set forth in SEQ ID NO:942); and/or the J-K loop (corresponding to amino acids 522-534 of SEQ ID NO:2) of a first terpene synthase is replaced with amino acids 527-541 of the UPS set forth in SEQ ID NO:942).

In the methods provided herein, all or a contiguous portion of an endogenous domain of a first terpene synthase can be replaced with all or a contiguous portion of the corresponding heterologous domain from a second terpene synthase using a suitable recombinant method known in the art as discussed above in Section C.2.

E. Production of Modified Valencene Synthase Polypeptides and Encoding Nucleic Acid Molecules Terpene synthase polypeptides and active fragments thereof, including valencene synthase polypeptides and active fragments thereof, can be obtained by methods well known in the art for recombinant protein generation and expression. Such polypeptides can be used to produce valencene from any suitable acyclic pyrophosphate terpene precursor, such as FPP, GPP or GGPP, in the host cell from which the synthase is expressed, or in vitro following purification of the synthase. Any method known to those of skill in the art for identification of nucleic acids that encode desired genes can be used to obtain the nucleic acid encoding a terpene synthase, such as a valencene synthase. For example, nucleic acid encoding unmodified or wild type valencene synthase polypeptides can be obtained using well known methods from a plant source, such as citrus (e.g. orange or grapefruit). Modified valencene polypeptides can then be engineered using any method known in the art for introducing mutations into unmodified or wild type valencene synthases, including any method described herein, such as random mutagenesis of the encoding nucleic acid by error-prone PCR, site-directed mutagenesis, overlap PCR, or other recombinant methods. The nucleic acid encoding the polypeptides can then be introduced into a host cell to be expressed heterologously.

In some examples, the terpene synthases provided herein, including modified valencene synthase polypeptides, are produced synthetically, such as using solid phase or solutions phase peptide synthesis.

1. Isolation of Nucleic Acid Encoding Terpene Synthases

Nucleic acid encoding terpene synthases, such as valencene synthase, can be cloned or isolated using any available methods known in the art for cloning and isolating nucleic acid molecules. Such methods include PCR amplification of nucleic acids and screening of libraries, including nucleic acid hybridization screening. In some examples, methods for amplification of nucleic acids can be used to isolate nucleic acid molecules encoding a valencene synthase polypeptide, including for example, polymerase chain reaction (PCR) methods. A nucleic acid containing material can be used as a starting material from which a valencene synthase-encoding nucleic acid molecule can be isolated. For example, DNA and mRNA preparations from citrus fruit, including, but not limited to, orange (*Citrus sinensis*) and grapefruit (*Citrus paradisi*) can be used to obtain valencene synthase genes. Nucleic acid libraries also can be used as a source of starting material. Primers can be designed to amplify a terpene synthase-encoding molecule, such as a valencene synthase-encoding molecule. For example, primers can be designed based on known nucleic acid sequences encoding a terpene synthase, such as valencene synthase, such as those set forth in SEQ ID NOS:1 and 292-294, or from back-translation of a valencene synthase amino acid sequence. Nucleic acid molecules generated by amplification can be sequenced and confirmed to encode a valencene synthase polypeptide.

Additional nucleotide sequences can be joined to a valencene synthase-encoding nucleic acid molecule, including linker sequences containing restriction endonuclease sites for the purpose of cloning the synthetic gene into a vector, for example, a protein expression vector or a vector designed for the amplification of the core protein coding DNA sequences. Furthermore, additional nucleotide sequences specifying functional DNA elements can be operatively linked to a valencene synthase-encoding nucleic acid molecule. Still further, nucleic acid encoding other moieties or domains also can be included so that the resulting synthase is a fusion protein. For example, nucleic acids encoding other enzymes, such as FPP synthase, or tags, such as His tags.

2. Generation of Mutant or Modified Nucleic Acid

Nucleic acid encoding a modified terpene synthase, such as a modified valencene synthase, can be prepared or generated using any method known in the art to effect mutation. Methods for modification include standard rational and/or random mutagenesis of encoding nucleic acid molecules (using e.g., error prone PCR, random site-directed saturation mutagenesis, or rational site-directed mutagenesis, such as, for example, mutagenesis kits (e.g. QuikChange available from Stratagene)). In addition, routine recombinant DNA techniques can be utilized to generate nucleic acids encoding polypeptides that contain heterologous amino acid. For example, nucleic acid encoding chimeric polypeptides or polypeptides containing heterologous amino acid sequence, can be generated using a two-step PCR method, such as described above and in Example 5, and/or using restriction enzymes and cloning methodologies for routine subcloning of the desired chimeric polypeptide components.

Once generated, the nucleic acid molecules can be expressed in cells to generate modified terpene synthase polypeptides using any method known in the art. The modified terpene synthase polypeptides, such as modified valencene synthase polypeptides, can then be assessed by screening for a desired property or activity, for example, for the ability to produce a terpene from a substrate. In particular examples, modified terpene synthases with desired properties are generated by mutation and screened for a property in accord with the examples exemplified herein. Typically, in instances where a modified valencene synthase is generated, the modified valencene synthase polypeptides produce valencene from FPP.

Thus, provided herein are nucleic acids encoding any of the modified terpene synthases described herein, including any of the modified valencene synthase polypeptides described above and herein. Any of the nucleic acid molecules provided herein can be isolated or purified using methods well known in the art, or can be contained in a vector or cell. Exemplary of nucleic acid molecules provided herein are any set forth in Table 3 or 5A, or degenerates thereof. For example, exemplary of nucleic acid molecules provided herein are any that encode a modified valencene synthase polypeptide provided herein, such as any encoding a polypeptide set forth in any of SEQ ID NOS: 3-127, 350, 351, 723-731, 732-745, 746-751, 810-866, 887-890 and 895, or degenerates thereof. In one embodiment, nucleic acid molecules provided herein have at least 50, 60, 65, 70, 75, 80, 85, 90, 91, 92, 93, 94, 95, or 99% sequence identity or hybridize under conditions of medium or high stringency along at least 70% of the full-length of any nucleic acid encoding a modified valencene synthase polypeptide provided herein. For example, the nucleic acid molecules provided herein have at least or at least about at least 50, 60, 65, 70, 75, 80, 85, 90, 91, 92, 93, 94, 95, or 99% sequence identity to the nucleic acid sequence set forth in SEQ ID NO:1. In another embodiment, a nucleic acid molecule can include those with degenerate codon sequences encoding any of the valencene synthase polypeptides provided herein. Table 3 and 5A set forth exemplary nucleic acid sequences of exemplary modified valencene synthase polypeptides provided herein.

3. Vectors and Cells

For recombinant expression of one or more of the modified terpene synthase polypeptides provided herein, including modified valencene synthase polypeptides, the nucleic acid containing all or a portion of the nucleotide sequence encoding the synthase can be inserted into an appropriate expression vector, i.e., a vector that contains the necessary elements for the transcription and translation of the inserted protein coding sequence. Depending upon the expression system used, the necessary transcriptional and translational signals also can be supplied by the native promoter for a valencene synthase gene, and/or their flanking regions. Thus, also provided herein are vectors that contain nucleic acid encoding the modified valencene synthase polypeptides. Cells, including prokaryotic and eukaryotic cells, containing the vectors also are provided. Such cells include bacterial cells, yeast cells, fungal cells, Archea, plant cells, insect cells and animal cells. In particular examples, the cells are yeast, such as *Saccharomyces cerevisiae*, that express an acyclic pyrophosphate terpene precursor, such as FPP. The cells are used to produce a terpene synthase, such as a valencene synthase polypeptide or modified valencene synthase polypeptide, by growing the above-described cells under conditions whereby the encoded valencene synthase is expressed by the cell. In some instances, the expressed synthase is purified. In other instances, the expressed synthase, such as valencene synthase, converts FPP to one or more terpenes (e.g. valencene) in the host cell.

Any method known to those of skill in the art for the insertion of DNA fragments into a vector can be used to construct expression vectors containing a chimeric gene containing appropriate transcriptional/translational control signals and protein coding sequences. These methods can include in vitro recombinant DNA and synthetic techniques and in vivo recombinants (genetic recombination). Expression of nucleic acid sequences encoding a valencene synthase polypeptide or modified valencene synthase polypeptide, or domains, derivatives, fragments or homologs thereof, can be regulated by a second nucleic acid sequence so that the genes or fragments thereof are expressed in a host transformed with the recombinant DNA molecule(s). For example, expression of the proteins can be controlled by any promoter/enhancer known in the art. In a specific embodiment, the promoter is not native to the genes for a valencene synthase protein. Promoters that can be used include but are not limited to prokaryotic, yeast, mammalian and plant promoters. The type of promoter depends upon the expression system used, described in more detail below.

In a specific embodiment, a vector is used that contains a promoter operably linked to nucleic acids encoding a valencene synthase polypeptide or modified valencene synthase polypeptide, or a domain, fragment, derivative or homolog thereof, one or more origins of replication, and optionally, one or more selectable markers (e.g., an antibiotic resistance gene). Vectors and systems for expression of valencene synthase polypeptides are described.

4. Expression Systems

Terpene synthase polypeptides, including valencene synthase polypeptides (modified and unmodified) can be produced by any methods known in the art for protein production including in vitro and in vivo methods such as, for example, the introduction of nucleic acid molecules encoding the terpene synthase (e.g. valencene synthase) into a host cell or host plant for in vivo production or expression from nucleic acid molecules encoding the terpene synthase (e.g. valencene synthase) in vitro. Terpene synthases such as valencene synthase and modified valencene synthase polypeptides can be expressed in any organism suitable to produce the required amounts and forms of a synthase polypeptide. Expression hosts include prokaryotic and eukaryotic organisms such as *E. coli*, yeast, plants, insect cells, mammalian cells, including human cell lines and transgenic animals. Expression hosts can differ in their protein production levels as well as the types of post-translational modifications that are present on the expressed proteins. The choice of expression host can be made based on these and other factors, such as regulatory and safety considerations, production costs and the need and methods for purification.

Expression in eukaryotic hosts can include expression in yeasts such as those from the *Saccharomyces* genus (e.g. *Saccharomyces cerevisiae*) and *Pichia* genus (e.g. *Pichia pastoria*), insect cells such as *Drosophila* cells and lepidopteran cells, plants and plant cells such as citrus, tobacco, corn, rice, algae, and lemna. Eukaryotic cells for expression also include mammalian cells lines such as Chinese hamster ovary (CHO) cells or baby hamster kidney (BHK) cells. Eukaryotic expression hosts also include production in transgenic animals, for example, including production in serum, milk and eggs.

Many expression vectors are available and known to those of skill in the art for the expression of a terpene synthase, such as valencene synthase. The choice of expression vector is influenced by the choice of host expression system. Such selection is well within the level of skill of the skilled artisan. In general, expression vectors can include transcriptional promoters and optionally enhancers, translational signals, and transcriptional and translational termination signals. Expression vectors that are used for stable transformation typically have a selectable marker which allows selection and maintenance of the transformed cells. In some cases, an origin of replication can be used to amplify the copy number of the vectors in the cells.

Terpene synthases, including valencene synthase and modified valencene synthase polypeptides, also can be utilized or expressed as protein fusions. For example, a fusion can be generated to add additional functionality to a polypeptide. Examples of fusion proteins include, but are not limited to, fusions of a signal sequence, a tag such as for localization, e.g. a $his_6$ tag or a myc tag, or a tag for purification, for example, a GST fusion, and a sequence for directing protein secretion and/or membrane association. In other examples, sesquiterpene synthases such as valencene synthase or modified valencene synthase polypeptides can be fused to FPP synthase, as described in Brodelius et al. (*Eur. J. Biochem.* (2002) 269: 3570-3579).

Methods of production of terpene synthase polypeptides, including valencene synthase polypeptides, can include coexpression of an acyclic pyrophosphate terpene precursor, such as FPP, in the host cell. In some instances, the host cell naturally expresses FPP. Such a cell can be modified to express greater quantities of FPP (see e.g. U.S. Pat. No. 6,531,303). In other instances, a host cell that does not naturally produce FPP is modified genetically to produce FPP.

a. Prokaryotic Cells

Prokaryotes, especially *E. coli*, provide a system for producing large amounts of the modified valencene synthase polypeptides provided herein. Transformation of *E. coli* is a simple and rapid technique well known to those of skill in the art. Exemplary expression vectors for transformation of *E. coli* cells, include, for example, the pGEM expression vectors, the pQE expression vectors, and the pET expression vectors (see, U.S. Pat. No. 4,952,496; available from NOVAGEN, Madison, Wis.; see, also literature published by Novagen describing the system). Such plasmids include pET 11a, which contains the T7lac promoter, T7 terminator, the inducible *E. coli* lac operator, and the lac repressor gene; pET 12a-c, which contains the T7 promoter, T7 terminator, and the *E. coli* ompT secretion signal; and pET 15b and pET19b (NOVAGEN, Madison, Wis.), which contain a His-Tag™ leader sequence for use in purification with a His column and a thrombin cleavage site that permits cleavage following purification over the column, the T7-lac promoter region and the T7 terminator.

Expression vectors for *E. coli* can contain inducible promoters that are useful for inducing high levels of protein expression and for expressing proteins that exhibit some toxicity to the host cells. Exemplary prokaryotic promoters include, for example, the β-lactamase promoter (Jay et al., (1981) *Proc. Natl. Acad. Sci. USA* 78:5543) and the tac promoter (DeBoer et al., *Proc. Natl. Acad. Sci. USA* 80:21-25 (1983)); see also "Useful Proteins from Recombinant Bacteria": in Scientific American 242:74-94 (1980). Examples of inducible promoters include the lac promoter, the trp promoter, the hybrid tac promoter, the T7 and SP6 RNA promoters and the temperature regulated $\lambda P_L$ promoter.

Terpene synthases, including valencene synthase can be expressed in the cytoplasmic environment of *E. coli*. The cytoplasm is a reducing environment and for some molecules, this can result in the formation of insoluble inclusion bodies. Reducing agents such as dithiothreitol and β-mercaptoethanol and denaturants (e.g., such as guanidine-HCl and urea) can be used to resolubilize the proteins. An alternative approach is the expression of valencene synthase in the periplasmic space of bacteria which provides an oxidizing environment and chaperonin-like and disulfide isomerases leading to the production of soluble protein. Typically, a leader sequence is fused to the protein to be expressed which directs the protein to the periplasm. The leader is then removed by signal peptidases inside the periplasm. Examples of periplasmic-targeting leader sequences include the pelB leader from the pectate lyase gene and the leader derived from the alkaline phosphatase gene. In some cases, periplasmic expression allows leakage of the expressed protein into the culture medium. The secretion of proteins allows quick and simple purification from the culture supernatant. Proteins that are not secreted can be obtained from the periplasm by osmotic lysis. Similar to cytoplasmic expression, in some cases proteins can become insoluble and denaturants and reducing agents can be used to facilitate solubilization and refolding. Temperature of induction and growth also can influence expression levels and solubility. Typically, temperatures between 25° C. and 37° C. are used. Mutations also can be used to increase solubility of expressed proteins. Typically, bacteria produce aglycosylated proteins.

b. Yeast Cells

Yeasts such as those from the *Saccharomyces* genus (e.g. *Saccharomyces cerevisiae*) *Schizosaccharomyces pombe, Yarrowia lipolytica, Kluyveromyces lactis*, and *Pichia pastoris* can be used to express the terpene synthases, such as the valencene synthase polypeptides, including the modified valencene synthase polypeptides, provided herein. Yeast can be transformed with episomal replicating vectors or by stable chromosomal integration by homologous recombination. In some examples, inducible promoters are used to regulate gene expression. Exemplary promoter sequences for expression of valencene synthase polypeptides in yeast include, among others, promoters for metallothionine, 3-phosphoglycerate kinase (Hitzeman et al., *J. Biol. Chem.* 255:12073, 1980), or other glycolytic enzymes (Hess et al., *Adv. Enzyme Reg.* 7:149, 1969; and Holland et al., *Biochem.* 17:4900, 1978), such as enolase, glyceraldehyde phosphate dehydrogenase, hexokinase, pyruvate decarboxylase, phosphofructokinase, glucose phosphate isomerase, 3-phosphoglycerate mutase, pyruvate kinase, triosephosphate isomerase, phosphoglucose isomerase, and glucokinase.

Other suitable vectors and promoters for use in yeast expression are further described in Hitzeman, EPA-73,657 or in Fleer et al., *Gene,* 107:285-295 (1991); and van den Berg et al., *Bio/Technology,* 8:135-139 (1990). Another alternative includes, but is not limited to, the glucose-repressible ADH2 promoter described by Russell et al. (*J. Biol. Chem.* 258: 2674, 1982) and Beier et al. (*Nature* 300:724, 1982), or a modified ADH1 promoter. Shuttle vectors replicable in both yeast and *E. coli* can be constructed by, for example, inserting DNA sequences from pBR322 for selection and replication in *E. coli* (Ampr gene and origin of replication) into the above-described yeast vectors. Exemplary of yeast shuttle vectors is YEp-CVS-ura, described in Example 1, below.

Yeast expression vectors can include a selectable marker such as LEU2, TRP1, HIS3, and URA3 for selection and maintenance of the transformed DNA. Proteins expressed in yeast are often soluble and co-expression with chaperonins, such as Bip and protein disulfide isomerase, can improve expression levels and solubility. Additionally, proteins expressed in yeast can be directed for secretion using secretion signal peptide fusions such as the yeast mating type alpha-factor secretion signal from *Saccharomyces cerevisiae* and fusions with yeast cell surface proteins such as the Aga2p mating adhesion receptor or the *Arxula adeninivorans* glucoamylase. A protease cleavage site (e.g., the Kex-2 protease) can be engineered to remove the fused sequences from the polypeptides as they exit the secretion pathway.

Yeast naturally express the required proteins, including FPP synthase (which can produce FPP) for the mevalonate-dependent isoprenoid biosynthetic pathway. Thus, expression of the modified terpene synthases, including modified valencene synthase polypeptides provided herein, in yeast cells can result in the production of terpenes, such as valencene, from FPP. Exemplary yeast cells for the expression of terpene synthases, including modified valencene synthase polypeptides, include yeast modified to express increased levels of FPP. For example, yeast cells can be modified to produce less squalene synthase or less active squalene synthase (e.g. erg9 mutants; see e.g. U.S. Pat. Nos. 6,531,303 and 6,689,593). This results in accumulation of FPP in the host cell at higher levels compared to wild-type yeast cells, which in turn can result in increased yields of terpenes (e.g. valencene). Exemplary modified yeast cells include, but are not limited to, modified *Saccharomyces cerevisiae* strains CALI5-1 (ura3, leu2, his3, trp1, Δ erg9::HIS3, HMG2cat/TRP1::rDNA, dpp1, sue), ALX7-95 (ura3, his3, trp1, Δerg9::HIS3, HMG2cat/TRP1::rDNA, dpp1 sue), ALX11-30 (ura3, trp1, erg9$^{def}$25, HMG2cat/TRP1::rDNA, dpp1, sue) and those described in U.S. Pat. Nos. 6,531,303, 6,689,593, and published U.S. Patent Appl. No. US20040249219.

c. Plants and Plant Cells

Transgenic plant cells and plants can be used for the expression of terpene synthases, including modified valencene synthase polypeptides. Expression constructs are typically transferred to plants using direct DNA transfer such as microprojectile bombardment and PEG-mediated transfer into protoplasts, and with *agrobacterium*-mediated transformation. Expression vectors can include promoter and enhancer sequences, transcriptional termination elements, and translational control elements. Expression vectors and transformation techniques are usually divided between dicot hosts, such as *Arabidopsis* and tobacco, and monocot hosts, such as corn and rice. Examples of plant promoters used for expression include the cauliflower mosaic virus promoter, the nopaline synthase promoter, the ribose bisphosphate carboxylase promoter and the ubiquitin and UBQ3 promoters. Selectable markers such as hygromycin, phosphomannose isomerase and neomycin phosphotransferase are often used to facilitate selection and maintenance of transformed cells. Transformed plant cells can be maintained in culture as cells, aggregates (callus tissue) or regenerated into whole plants. Transgenic plant cells also can include algae engineered to produce proteins (see, for example, Mayfield et al. (2003) PNAS 100:438-442). Transformed plants include, for example, plants selected from the genera *Nicotiana, Solanum, Sorghum, Arabidopsis, Medicago* (alfalfa), *Gossypium* (cotton), *Brassica* (rape). In some examples, the plant belongs to the species of *Nicotiana tabacum*, and is transformed with vectors that overexpress the valencene synthase and farnesyl diphosphate synthase, such as described in U.S. Pat. Pub. No. 20090123984.

d. Insects and Insect Cells

Insects and insect cells, particularly using a baculovirus expression system, can be used for expressing terpene synthase, including modified valencene synthase polypeptides (see, for example, Muneta et al. (2003) *J. Vet. Med. Sci.* 65(2):219-23). Insect cells and insect larvae, including expression in the haemolymph, express high levels of protein and are capable of most of the post-translational modifications used by higher eukaryotes. Baculoviruses have a restrictive host range which improves the safety and reduces regulatory concerns of eukaryotic expression. Typically, expression vectors use a promoter such as the polyhedrin promoter of baculovirus for high level expression. Commonly used baculovirus systems include baculoviruses such as *Autographa californica* nuclear polyhedrosis virus (AcNPV), and the *Bombyx mori* nuclear polyhedrosis virus (BmNPV) and an insect cell line such as Sf9 derived from *Spodoptera frugiperda, Pseudaletia unipuncta* (A7S) and *Danaus plexippus* (DpN1). For high level expression, the nucleotide sequence of the molecule to be expressed is fused immediately downstream of the polyhedrin initiation codon of the virus. Mammalian secretion signals are accurately processed in insect cells and can be used to secrete the expressed protein into the culture medium. In addition, the cell lines *Pseudaletia unipuncta* (A7S) and *Danaus plexippus* (DpN1) produce proteins with glycosylation patterns similar to mammalian cell systems.

An alternative expression system in insect cells is the use of stably transformed cells. Cell lines such as the Schnieder 2 (S2) and Kc cells (*Drosophila melanogaster*) and C7 cells (*Aedes albopictus*) can be used for expression. The *Drosophila* metallothionein promoter can be used to induce high levels of expression in the presence of heavy metal induction with cadmium or copper. Expression vectors are typically maintained by the use of selectable markers such as neomycin and hygromycin.

e. Mammalian Expression

Mammalian expression systems can be used to express terpene synthase, including modified valencene synthase polypeptides. Expression constructs can be transferred to mammalian cells by viral infection such as adenovirus or by direct DNA transfer such as liposomes, calcium phosphate, DEAE-dextran and by physical means such as electroporation and microinjection. Expression vectors for mammalian cells typically include an mRNA cap site, a TATA box, a translational initiation sequence (Kozak consensus sequence) and polyadenylation elements. Such vectors often include transcriptional promoter-enhancers for high level expression, for example the SV40 promoter-enhancer, the human cytomegalovirus (CMV) promoter, and the long terminal repeat of Rous sarcoma virus (RSV). These promoter-enhancers are active in many cell types. Tissue and cell-type promoters and enhancer regions also can be used for expression. Exemplary promoter/enhancer regions include, but are not limited to, those from genes such as elastase I, insulin, immunoglobulin, mouse mammary tumor virus, albumin, alpha-fetoprotein, alpha 1-antitrypsin, beta-globin, myelin basic protein, myosin light chain-2, and gonadotropic releasing hormone gene control. Selectable markers can be used to select for and maintain cells with the expression construct. Examples of selectable marker genes include, but are not limited to, hygromycin B phosphotransferase, adenosine deaminase, xanthine-guanine phosphoribosyl transferase, aminoglycoside phosphotransferase, dihydrofolate reductase and thymidine kinase. Fusion with cell surface signaling molecules such as TCR-ζ and $Fc_{\epsilon}RI$-γ can direct expression of the proteins in an active state on the cell surface.

Many cell lines are available for mammalian expression including mouse, rat, human, monkey, chicken and hamster cells. Exemplary cell lines include, but are not limited to, BHK (i.e. BHK-21 cells), 293-F, CHO, CHO Express (CHOX; Excellgene), Balb/3T3, HeLa, MT2, mouse NS0 (non-secreting) and other myeloma cell lines, hybridoma and heterohybridoma cell lines, lymphocytes, fibroblasts, Sp2/0, COS, NIH3T3, HEK293, 293S, 293T, 2B8, and HKB cells. Cell lines also are available adapted to serum-free media which facilitates purification of secreted proteins from the cell culture media. One such example is the serum free EBNA-1 cell line (Pham et al., (2003) *Biotechnol. Bioeng.* 84:332-42).

5. Purification

Methods for purification of terpene synthases, such as valencene synthase, including modified valencene synthase polypeptides, from host cells depend on the chosen host cells and expression systems. For secreted molecules, proteins are generally purified from the culture media after removing the cells. For intracellular expression, cells can be lysed and the proteins purified from the extract. When transgenic organisms such as transgenic plants and animals are used for expression, tissues or organs can be used as starting material to make a lysed cell extract. Additionally, transgenic animal production can include the production of polypeptides in milk or eggs, which can be collected, and if necessary the proteins can be extracted and further purified using standard methods in the art.

Terpene synthases, including valencene synthase, can be purified using standard protein purification techniques known in the art including but not limited to, SDS-PAGE, size fraction and size exclusion chromatography, ammonium sulfate precipitation, chelate chromatography and ionic exchange chromatography. Expression constructs also can be engineered to add an affinity tag such as a myc epitope, GST fusion or $His_6$ and affinity purified with myc antibody, glutathione resin, and Ni-resin, respectively, to a protein. Purity can be assessed by any method known in the art including gel electrophoresis and staining and spectrophotometric techniques.

6. Fusion Proteins

Fusion proteins containing a modified terpene synthase, including modified valencene synthase polypeptides, and one or more other polypeptides also are provided. Linkage of a terpene synthase polypeptide with another polypeptide can be effected directly or indirectly via a linker. In one example, linkage can be by chemical linkage, such as via heterobifunctional agents or thiol linkages or other such linkages. Fusion also can be effected by recombinant means. Fusion of a terpene synthase, such as a valencene synthase polypeptide, to another polypeptide can be to the N- or C-terminus of the valencene synthase polypeptide.

A fusion protein can be produced by standard recombinant techniques. For example, DNA fragments coding for the different polypeptide sequences can be ligated together in-frame in accordance with conventional techniques, e.g., by employing blunt-ended or stagger-ended termini for ligation, restriction enzyme digestion to provide for appropriate termini, filling-in of cohesive ends as appropriate, alkaline phosphatase treatment to avoid undesirable joining, and enzymatic ligation. In another embodiment, the fusion gene can be synthesized by conventional techniques including automated DNA synthesizers. Alternatively, PCR amplification of gene fragments can be carried out using anchor primers that give rise to complementary overhangs between two consecutive gene fragments that can subsequently be annealed and reamplified to generate a chimeric gene sequence (see, e.g., Ausubel et al. (eds.) Current Protocols in Molecular Biology, John Wiley & Sons, 1992). Moreover, many expression vectors are commercially available that already encode a fusion moiety (e.g., a GST polypeptide). A valencene synthase polypeptide-encoding nucleic acid can be cloned into such an expression vector such that the fusion moiety is linked in-frame to the valencene synthase protein.

F. Methods of Using and Assessing Terpene Synthases

The modified terpene synthases provided herein can be used to, and assessed for their ability to, produce terpenes, including monoterpenes, diterpenes and sesquiterpenes, from any suitable acyclic pyrophosphate terpene precursor, including, but not limited to, farnesyl diphosphate (FPP), geranyl diphosphate (GPP) or geranyl-geranyl diphosphate (GGPP). Typically, the modified valencene synthase polypeptides provided herein catalyze the formation of valencene from FPP. Any method known to one of skill in the art can be used to produce terpenes, including valencene, with the modified terpene synthases, such as the modified valencene synthases, provided herein. The ability of the modified synthases provided herein to catalyze the formation of valencene or other terpenes from FPP or other substrates can be assessed using these methods. In some examples, the amount of terpene, such as valencene, produced from FPP or another substrate using the modified synthases is compared to the amount of terpene, such as valencene, produced from the same substrate using wild-type or unmodified synthase.

Other activities and properties of the modified terpene synthases, such as the modified valencene synthase polypeptides, also can be assessed using methods and assays well known in the art. In addition to assessing the activity of the modified synthases and their ability to catalyze the formation of terpenes, the kinetics of the reaction, modified regiochemistry or stereochemistry, altered substrate utilization and/or altered product distribution (i.e. altered amount of the different terpenes produced from FPP or another substrate) compared to the wild-type or unmodified terpene synthase can be assessed using methods well known in the art. For example, the type and amount of various terpenes produced from FPP, GPP or GGPP by the modified terpene synthase polypeptides can be assessed by gas chromatography methods (e.g. GC-MS), such as those described below and in Example 5. In some examples, terpenes that can be produced by the modified valencene synthase polypeptides from FPP include, but are not limited to, valencene, germacrene A, β-elemene, β-selinene, τ-selinene and 7-epi-α-selinene.

Provided below are methods for the production of valencene and nootkatone from FPP using the modified valencene synthases provided herein. Such methods can be adapted by one of skill in the art to produce and assess other terpenes from FPP, GPP and/or GGPP by other modified terpene synthases provided herein.

1. Production of Valencene

The modified valencene synthase polypeptides can be used to catalyze the formation of valencene from an acyclic pyrophosphate terpene precursor, such as FPP. In some examples, the modified valencene synthases provided herein are expressed in cells that produce or overproduce FPP, such that valencene is produced by the pathway described above. In other examples, the modified valencene synthases provided herein are expressed and purified from any suitable host cell, such as described in Section D. The purified synthases are then combined in vitro with a FPP to produce valencene.

In some examples, the modified valencene synthase provided herein is overexpressed and purified as described in Section D above. The modified valencene synthase is then incubated with the substrate farnesyl diphosphate and valencene is produced. The pH of the solution containing FPP and valencene synthase can impact the amount of valencene produced (see e.g. U.S. Pat. Pub. No. 20100216186). An organic solvent is added to partition the valencene into the organic phase for analysis. Production of valencene and quantification of the amount of product are then determined using any method provided herein, such as gas chromatography (e.g. GC-MS) using an internal standard. Alternatively, the modified valencene synthase is expressed in host cells that also produce FPP, resulting in production of valencene. The valencene can then be extracted from the cell culture medium with an organic solvent and subsequently isolated and purified by any known method, such as column chromatography or HPLC, and the amount and purity of the recovered valencene are assessed. In some examples, the valencene is converted by oxidation to nootkatone either before or after purification.

a. Exemplary Cells for Valencene Production

Valencene can be produced by expressing a modified valencene synthase polypeptide provided herein in a cell line that produces FPP as part of the mevalonate-dependent isoprenoid biosynthetic pathway (e.g. fungi, including yeast cells and animal cells) or the mevalonate-independent isoprenoid biosynthetic pathway (e.g. bacteria and higher plants). In particular examples, valencene is produced by expressing a modified valencene synthase polypeptide provided herein in a cell line that has been modified to overproduce FPP. Exemplary of such cells are modified yeast cells. For example, yeast cells that have been modified to produce less squalene synthase or less active squalene synthase (e.g. erg9 mutants; see e.g. U.S. Pat. Nos. 6,531,303 and 6,689,593) are useful in the methods provided herein to produce valencene. Reduced squalene synthase activity results in accumulation of FPP in the host cell at higher levels compared to wild-type yeast cells, which in turn can result in increased yields of valencene production. Exemplary modified yeast cells include, but are not limited to, modified *Saccharomyces cerevisiae* strains CALI5-1 (ura3, leu2, his3, trp1, Δerg9::HIS3, HMG2cat/TRP1::rDNA, dpp1), ALX7-95 (ura3, his3, trp1, Δerg9::HIS3, HMG2cat/TRP1::rDNA, dpp1, sue), ALX11-30 (ura3, trp1, erg9$^{def}$ 25, HMG2cat/TRP1::rDNA, dpp1, sue) and those described in U.S. Pat. Nos. 6,531,303 and 6,689,593 and published U.S. Patent Appl. No. US20040249219.

*Saccharomyces cerevisiae* strain CALI5-1 is a derivative of SW23B#74 (described in U.S. Pat. Nos. 6,531,303 and 6,689,593, and Takahashi et al. (2007) *Biotechnol Bioeng.* 97(1): 170-181), which itself is derived from wild-type strain ATCC 28383 (MATa). CALI5-1 was generated to have a decreased activity of the Dpp1 phosphatase (see e.g. U.S. Published Appl. No. US20040249219). *Saccharomyces cerevisiae* strain CALI5-1 contains, among other mutations, an erg9 mutation (the Δerg9::HIS3 allele) as well as a mutation supporting aerobic sterol uptake enhancement (sue). It also contains approximately 8 copies of the truncated HMG2 gene. The truncated form of HMG2 is driven by the GPD promoter and is therefore no longer under tight regulation, allowing for an increase in carbon flow to FPP. It also contains a deletion in the gene encoding diacylglycerol pyrophosphate (DGPP) phosphatase enzyme (dpp1), which limits dephosphorylation of FPP.

ALX7-95 and ALX11-30.1 are derivatives of CALI5-1. ALX7-95 was derived from CALI5-1 by correcting the Δleu2 deficiency of CALI5-1 with a functional leu gene so that leucine is not required to be supplemented to the media (see e.g. US2010/0151519). ALX11-30 was constructed from CAL5-1 in several steps, described in Example 2, below.

b. Culture of Cells for Valencene Production

In exemplary methods, a modified valencene synthase provided herein is expressed in a host cell line that has been modified to overexpress farnesyl diphosphate whereby upon expression of the modified valencene synthase, farnesyl diphosphate is converted to valencene. The host cell is cultured using any suitable method well known in the art. In some examples, such as for high throughput screening of cells expressing various modified valencene synthases, the cells expressing the modified valencene synthase are cultured in individual wells of a 96-well plate (see e.g. Example 3C, below). In other examples where the host cell is yeast, the cells expressing the modified valencene synthase polypeptides and FPP are cultured using fermentation methods such as those described in the Examples below.

A variety of fermentation methodologies can be utilized for the production of valencene from yeast cells expressing the modified valencene synthase polypeptides provided herein. For example, large scale production can be effected by either batch or continuous fermentation. A classical batch fermentation is a closed system where the composition of the medium is set at the beginning of the fermentation and not subject to artificial alterations during the fermentation. Thus, at the beginning of the fermentation the medium is inoculated with the desired microorganism or microorganisms and fermentation is permitted to occur without further addition of nutrients. Typically, the concentration of the carbon source in a batch fermentation is limited, and factors such as pH and oxygen concentration are controlled. In batch systems the metabolite and biomass compositions of the system change constantly up to the time the fermentation is stopped. Within batch cultures cells typically modulate through a static lag phase to a high growth log phase and finally to a stationary phase where growth rate is diminished or halted. If untreated, cells in the stationary phase will eventually die.

A variation on the standard batch system is the Fed-Batch system, which is similar to a typical batch system with the exception that nutrients are added as the fermentation progresses. Fed-Batch systems are useful when catabolite repression tends to inhibit the metabolism of the cells and where it is desirable to have limited amounts of substrate in the medium. Also, the ability to feed nutrients will often result in higher cell densities in Fed-Batch fermentation processes compared to Batch fermentation processes. Factors such as pH, dissolved oxygen, nutrient concentrations, and the partial pressure of waste gases such as CO are generally measured and controlled in Fed-Batch fermentations.

Production of the valencene also can be accomplished with continuous fermentation. Continuous fermentation is an open system where a defined fermentation medium is added continuously to a bioreactor and an equal amount of conditioned medium is removed simultaneously for processing. This system generally maintains the cultures at a constant high density where cells are primarily in their log phase of growth. Continuous fermentation allows for modulation of any number of factors that affect cell growth or end product concentration. For example, one method will maintain a limiting nutrient such as the carbon source or nitrogen level at a fixed rate and allow all other parameters to moderate. In other systems a number of factors affecting growth can be altered continuously while the cell concentration, measured by the medium turbidity, is kept constant. Continuous systems aim to maintain steady state growth conditions and thus the cell loss due to the medium removal must be balanced against the cell growth rate in the fermentation. Methods of modulating nutrients and growth factors for continuous fermentation processes as well as techniques for maximizing the rate of product formation are well known in the art.

Following cell culture, the cell culture medium can then be harvested to obtain the produced valencene.

In one exemplary method, the host cells expressing the modified valencene synthase polypeptides (e.g. *Saccharomyces cerevisiae* strain CALI5-1, ALX7-95 or ALX11-30) are grown in 3 L fermentation tank at 28° C., pH 4.5 for approximately 132 hours, maintaining glucose at between 0 and 1 g/L (see Example 2). Following fermentation, sodium sulfate is added to a final concentration of 10-15. Soybean oil also is added and agitated, and the oil containing the valencene (and other terpenes) is recovered by centrifugation.

c. Isolation and Assessment of Valencene

The valencene produced using the methods above with the modified valencene synthase polypeptides provided herein can be isolated and assessed by any method known in the art. In one example, the cell culture medium is extracted with an organic solvent to partition valencene and any other terpene produced, into the organic layer. Valencene production can be assessed and/or the valencene isolated from other products using any method known in the art, such as, for example, gas chromatography. For example, the organic layer can be analyzed by gas chromatography using cedrene and hexadecane as internal standards. This method is exemplified in Example 2 below.

The quantity of valencene produced can be determined by any known standard chromatographic technique useful for separating and analyzing organic compounds. For example, valencene production can be assayed by any known chromatographic technique useful for the detection and quantification of hydrocarbons, such as valencene and other terpenes, including, but not limited to, gas chromatography mass spectrometry (GC-MS), gas chromatography using a flame ionization detector (GC-FID), capillary GC-MS, high performance liquid chromatography (HPLC) and column chromatography. Typically, these techniques are carried out in the presence of known internal standards, for example, cedrene or hexadecane, which are used to quantify the amount of the terpene produced. For example, terpenes, including sesquiterpenes, such as valencene, can be identified by comparison of retention times and mass spectra to those of authentic standards in gas chromatography with mass spectrometry detection. Typical standards include, but are not limited to, cedrene and hexadecane. In other examples, quantification can be achieved by gas chromatography with flame ionization detection based upon calibration curves with known amounts of authentic standards and normalization to the peak area of an internal standard. These chromatographic techniques allow for the identification of any terpene present in the organic layer, including, for example, other terpenes produced by the modified valencene synthase, including, for example, germacrene A, β-selinene, τ-selinene and 7-epi-α-selinene (see e.g. Example 8).

In particular examples, the amount of valencene produced by the modified valencene synthase polypeptides provided herein from FPP is at least or about 110%, 120%, 130%, 140%, 150%, 160%, 170%, 180%, 190%, 200%, 250%, 300%, 350%, 400%, 500%, 600%, 700%, 800%, 900%, 1000% or more of the valencene produced from FPP by the wild-type valencene synthase polypeptide set forth in SEQ ID NO:2. Typically, the amount of valencene produced using the methods described above and exemplified in the Examples below is at least or is about 0.1 g/L, 0.2 g/L, 0.3 g/L, 0.4 g/L, 0.5 g/L, 0.6 g/L, 0.7 g/L, 0.8 g/L, 0.9 g/L 1.0 g/L, 1.1 g/L, 1.2 g/L, 1.3 g/L, 1.4 g/L, 1.5 g/L, 2.0 g/L, 2.5 g/L, 3.0 g/L, 3.5 g/L, 4.0 g/L, 4.5 g/L or 5.0 g/L or more.

In some examples, kinetics of valencene production can be determined by synthase assays in which radioactive isoprenoid substrates, such as $^{3}$H FPP or $^{14}$C FPP, are utilized with varying concentrations of synthase. The products are extracted into an organic layer and radioactivity is measured using a liquid scintillation counter. Kinetic constants are determined from direct fits of the Michaelis-Menton equation to the data.

2. Production of Nootkatone

The modified valencene synthases provided herein produce valencene, which can then be oxidized to nootkatone. Nootkatone, which is the dominant grapefruit aroma, is an oxidized product of valencene. Valencene can undergo regioselective hydroxylation to form 2-hydroxy valencene, which is further oxidized to form nootkatone. Oxidation of valencene can be carried out through chemical or biosynthetic means (see e.g. U.S. Pat. No. 5,847,226, Eur. Pat. No. EP1083233; Girhard et al., (2009) *Microb. Cell. Fact.* 8:36; Fraatz et al., (2009) *Appl Microbiol Biotechnol.* 83(1):35-41; Furusawa et al. (2005) *Chem Pharm. Bull.* 53:1513-1514; Salvador et al., (2002) *Green Chemistry,* 4, 352-356). Biochemical oxidation can be effected by a laccase, hydroxylase, or other oxidative enzyme. In some examples, valencene is converted to nootkatone using chromium trioxide or a silica phosphonate-immobilized chromium (III) catalyst (see e.g. Example 7). Nootkatone formation can be confirmed and/or quantified by any of the chromatographic techniques described herein.

G. Examples

The following examples are included for illustrative purposes only and are not intended to limit the scope of the invention.

Example 1

Cloning of Wild-Type Valencene Synthase

The valencene synthase gene (CVS) from *Citrus sinensis* cv. Valencia (Valencia orange) was cloned from RNA isolated from the juice vesicles of freshly harvested Valencia orange using the procedure previously described in Example 1 of U.S. Pat. No. 7,442,785.

First, Yep-GW-URA (Takahashi et al., (2007) *Biotechnol Bioeng.* 97(1):170-181) was generated by inserting a gateway cloning cassette (RfB) with the form attR1-Cm$^{R}$-ccdB gene-attR2 (Hartley et al., (2000) *Genome Res.* 10:1788-1795) into the SmaI restriction site of YEp352-URA (SEQ ID NO:692, Bio-Technical Resources), which contains an URA3 selectable marker, an ADH1 promoter and an ADH1 terminator flanking, two BamHI sites (one 5' to the ADH1 promoter and the other 3' to the ADH terminator), a 2-micron ori, an ampicillin resistance gene and a colE1 origin of replication. The resulting vector was designated YEp-CVS-URA.

The CVS gene (set forth in SEQ ID NO:1, and encoding amino acid sequence is set forth in SEQ ID NO:2) was then amplified from RNA isolated from the juice vesicles of freshly harvested Valencia orange to contain restriction sites for subcloning into the yeast shuttle expression vector Yep-GW-URA. Following digestion of Yep-GW-URA with EcoRI and XbaI, the amplified product was cloned into the yeast shuttle expression vector YEp-GW-URA.

The YEp-CVS-ura vector was maintained in *S. cerevisiae* by selecting on SD minimal medium lacking uracil at 28° C. The vector also was maintained in *Escherichia coli* by selecting for resistance to ampicillin on LB medium containing 100 μg/mL ampicillin.

Example 2

Production of Valencene

To screen for production of valencene, the *Saccharomyces cerevisiae* yeast cell strains CALI5-1 (ura3, leu2, his3, trp1, Δerg9::HIS3, HMG2cat/TRP1::rDNA, dpp1, sue), ALX7-95 (ura3, his3, trp1, Δerg9::HIS3, HMG2cat/TRP1::rDNA, dpp1, sue) or ALX11-30 (ura3, trp1, erg9def25, HMG2cat/TRP1::rDNA, dpp1, sue) were used.

The CALI5-1 strain (see U.S. published Appl. No. US20040249219; U.S. Pat. Nos. 6,531,303 and 6,689,593) has a Δleu2 deletion, which required the introduction of leucine into its media. ALX7-95 was derived from CALI5-1 by correcting the Δleu2 deficiency of CALI5-1 with a functional LEU2 gene (see U.S. published Appl. No. US2010/0151519).

ALX11-30 was constructed from CALI5-1 in several steps from ALX7-175.1 as described in US2010/0151519. Briefly, ALX7-95 HPS was obtained by transforming a plasmid containing the *Hyoscyamus muticus* premnaspirodiene synthase (HPS) into ALX7-95 strain. The YEp-HPS plasmid was obtained by cloning the gene for HPS into Yep-GW-URA to give YEp-HPS-ura (YEp-HPS). Then, an error prone PCR reaction of the ERG9 gene was performed, and the resulting DNA was transformed into ALX7-95 harboring YEpHPS. Transformants were plated on YP medium lacking ergosterol and screened for premnaspirodiene production. Those that produced high levels of premnaspirodiene were saved. One strain, ALX7-168.25 [ura3, trp1, his3, erg9$^{def}$25, HMG2cat/TRP1::rDNA, dpp1, sue, YEpHPS] was transformed with a PCR fragment of the complete HIS3 gene to create a functional HIS3 gene. Transformants were isolated that were able to grow in the absence of histidine in the medium. From this transformation, ALX7-175.1 was isolated [ura3, trp1, erg9def25, HMG2cat/TRP1::rDNA, dpp1, sue YEpHPS]. Finally, the plasmid YEpHPS was removed by growing ALX7-175.1 several generations in YPD (10 g/L yeast extract, 20 g/L peptone, 20 g/L glucose) and plating cells on YPD plates. Colonies were identified that were unable to grow on SD medium without uracil (0.67% Bacto yeast nitrogen base without amino acids, 2% glucose, 0.14% yeast synthetic drop-out medium without uracil). This strain was designated ALX11-30.

For screening for production of valencene by valencene synthase or mutants, the YEp-CVS-ura plasmid, containing the CVS gene or modified versions of the CVS gene, was transformed into the above yeast strains using the lithium acetate yeast transformation kit (Sigma-Aldrich). The ALX7-95 and ALX11-30 strains generally produced more valencene than the CALI5-1 strain. CALI5-1 was used for initial screening in vials (as described in Example 3) and production in fermenters. Subsequently, ALX7-95 or ALX11-30 were used for screening in vials and fermenters. Typically, ALX7-95 was used for screening in vials and ALX11-30 was used for fermenters.

Transformants were selected on SDE-ura medium (0.67% Bacto yeast nitrogen base without amino acids, 2% glucose, 0.14% yeast synthetic drop-out medium supplement without uracil, and 40 mg/L ergosterol as needed). Colonies were picked and screened for valencene production using the microculture assay described below.

Production of valencene was performed in a 3-L fermentation tank (New Brunswick Bioflow 110). One liter of fermentation medium was prepared and autoclaved in the fermentation tank (20 g $(NH_4)_2SO_4$, 20 g $KH_2PO_4$, 1 g NaCl, $MgSO_4.7H_2O$, 4 g Solulys corn steep solids (Roquette)). The following components were then added: 20 ml mineral solution (0.028% $FeSO_4.7H_2O$, 0.029% $ZnSO_4.7H_2O$, 0.008% $CuSO_4.5H_2O$, 0.024% $Na_2MoO_4.2H_2O$, 0.024% $CoCl_2.6H_2O$, 0.017% $MnSO_4.H_2O$, 1 mL HCl); 10 mL 50% glucose; 30 mL vitamin solution (0.001% biotin; 0.012% calcium pantothenate, 0.06% inositol, 0.012% pyridoxine-HCl, 0.012% thiamine-HCl); 10 mL 10% $CaCl_2$, and 20 mL autoclaved soybean oil (purchased from local groceries). For sterol-requiring strains, including CALI5-1 and ALX7-95, 50 mg/L cholesterol or 40 mg/L ergosterol was included in the medium.

The seed culture for inoculating the fermentation medium was prepared by inoculating 50 mL of SDE-ura-trp medium (see Example 3.C.2.) with CALI5-1, ALX7-95 or ALX11-30 containing the YEp-CVS-ura plasmid. This culture was grown at 28° C. until early stationary phase (24-48 hr). One mL of this culture was inoculated into 500 mL of SDE-ura-trp medium and grown for 24 hr at 28° C. A 50-mL aliquot (5% inoculum) was used to inoculate the medium in the fermentation tank.

The fermentor was maintained at 28° C. The air flow was 1 vvm and the $dO_2$ was maintained above 30% by adjusting the agitation. The pH was maintained at 4.5 using phosphoric acid and NaOH or $NH_4OH$.

When the glucose concentration fell below 1 g/L, a feeding regimen was initiated such that the glucose in the fermentor was kept between 0 and 1 g/L. The glucose feed consisted of 60% glucose (w/v).

At the end of the fermentation, generally about 132 hours after inoculation, sodium sulfate was added to 10-15% final concentration as was an additional 50 mL soybean oil, and the contents of the fermentor were agitated for one hour. After allowing the fermentation vessel contents to settle, the oil was recovered by centrifugation and the valencene content in the oil was determined.

To assay valencene, 3 mL of suspension was placed in a vial to which 3 mL of acetone containing 20 mg/L cedrene was added. After vortexing, the mixture was extracted with 6 mL hexane containing 10 mg/L hexadecane followed by additional vortexing. The organic phase was transferred to a second vial for analysis by gas chromatography using cedrene and hexadecane as internal standards for extraction efficiency and injection, respectively. The CALI5-1, ALX7-95 or ALX11-30 *S. cerevisiae* containing Yep-CVS-ura, and expressing valencene synthase, was found to produce valencene.

Example 3

Generation of Valencene Synthase Mutants

Valencene synthase mutants were generated by error-prone PCR (epPCR) of the valencene synthase gene. The mutants were then screened for their ability to produce valencene using a high throughput screening assay.

A. Generation of Valencene Synthase Mutants by epPCR

For error-prone PCR of the CVS gene, either the whole YEp-CVS-ura plasmid or a 3 kb BamHI DNA fragment containing the CVS gene, excised from plasmid and gel-purified, was used. DNA equivalent to between 270 to 360 ng of the CVS gene was used as template for error-prone PCR using the GeneMorph II random mutagenesis kit (Stratagene). PCR conditions were 30 cycles of 96° C. for 1 min, 55° C. annealing for 1 min, 72° C. extension for 2 min using the forward primer CVSperF1 (5'-CATTCACGCACACTACTCTCT-3', SEQ ID NO:344) and the reverse primer CVSperR1 (5'-GCCGACAACCTTGATTGGAG-3', SEQ ID NO:345). Digestion of the PCR reaction product using EcoRI and XbaI provided a library of mutagenized CVS genes, which were used to replace the wild type CVS gene of YEp-CVS-ura using the same restriction endonucleases. A plasmid library was prepared by passaging the DNA through *E. coli*. This DNA library was then used to transform yeast strains CALI5-1 or ALX7-95. Yeast transformants were screened as described in Example 2. Those transformants that produced elevated levels of valencene (>110%), as compared to transformants containing the wild type gene (110% of wildtype levels, i.e., a 10% increase versus wildtype), were retested in vial, shake flask, and fermentation cultures to confirm a higher level production of valencene. Plasmid DNA was isolated from strains confirmed to produce higher levels of valencene and was sequenced to determine amino acid changes in variant valencene synthase enzymes.

Table 6 sets forth the valencene synthase mutants that were produced using error prone PCR. The table includes the nucleotide mutations and the resulting amino acid mutations (if any), and the percentage increase in production of valencene compared to wild-type valencene synthase (assessed using transformants cultured in a shaker flask). When cultured in a shaker flask, clone V8 produced 287% more valencene than wildtype CVS.

TABLE 6

Valencene Synthase Variants

| Mutant | Nucleotide changes | Amino acid changes | SEQ ID NO nt | SEQ ID NO aa | Valencene % increase vs. wildtype in shake flask culture |
|---|---|---|---|---|---|
| V1 | G147A | silent | 131 | 6 | 60 |
| | G558T | silent | | | |
| | A640G | N214D | | | |
| | A1305G | silent | | | |
| | C1418A | S473Y | | | |
| V2 | C1214G | T405R | 132 | 7 | 80 |
| V3 | A108T | silent | 133 | 8 | 87 |
| | C1034T | A345V | | | |
| | C1218T | silent | | | |
| | T1608G | D536E | | | |
| | T1617A | silent | | | |
| V4 | A662G | Y221C | 134 | 9 | 65 |
| | A1626G | silent | | | |
| V5 | G714T | E238D | 135 | 10 | 18 |
| | T960A | silent | | | |
| V6 | T177C | silent | 136 | 11 | 39 |
| | A528T | silent | | | |
| | T625A | F2091 | | | |
| | C1026T | silent | | | |
| V7 | A289G | N97D | 137 | 12 | 41 |
| V8 | A999T | E333D | 138 | 13 | 287 |
| | A1106T | N369I | | | |

Additional valencene synthase mutants, set forth in Table 7, were then produced using a variety of methods. In the first method, the amino acid mutations in mutants V1 and V2 were combined using standard recombinant DNA and PCR methods to produce a variant designated V9. Similarly, the variant V10 was generated by recombination of mutations in V1, V2, and V3. Neither V9 nor V10 contained the S473Y mutation found in V1, as this mutation was eliminated during the restriction digest used to combine V1 with V2 or V3. The plasmid DNA from variant V9 was then subjected to error prone PCR using the methods described above to produce the variants V12, V13, V14 and V15. The plasmid DNA from variant V12 was then subjected to saturation mutagenesis at position 429 to produce the variant V16, and the plasmid DNA from variant V16 was subsequently subjected to saturation mutagenesis at position 221 to produce the variant V17. Table 7 sets forth the valencene synthase mutants with combined mutations, and includes the nucleotide mutations and the resulting amino acid mutations (if any), and the percentage increase in production of valencene compared to wildtype valencene synthase, or compared to the V1 variant for V9 and V10 (as assessed using transformants cultured in a shaker flask), or compared to V12 for variant V16, or compared to V16 for variant V17. When cultured in a shaker flask, clone V10 produced 88% more valencene than clone V1.

TABLE 7

Valencene Synthase Variants

| Mutant | Nucleotide changes | Amino acid changes | SEQ ID NO: nt | SEQ ID NO: aa | Valencene % increase vs. parent in shake flask culture |
|---|---|---|---|---|---|
| V9 | G147A | silent | 139 | 14 | 51 (vs. V1) |
| | G558T | silent | | | |
| | A640G | N214D | | | |
| | C1214G | T405R | | | |
| V10 | G147A | silent | 140 | 15 | 88 (vs. V1) |
| | G558T | silent | | | |
| | A640G | N214D | | | |
| | A966G | silent | | | |
| | C1034T | A345V | | | |
| | C1214G | T405R | | | |
| | C1218T | silent | | | |
| | G1587C | silent | | | |
| | T1608G | D536E | | | |
| | T1617A | silent | | | |
| V12 | G147A | silent | 141 | 16 | 67 (vs. V9) |
| | G178A | V60I | | | |
| | G558T | silent | | | |
| | T588C | silent | | | |
| | A640G | N214D | | | |
| | G1033A | A345T | | | |
| | C1214G | T405R | | | |
| V13 | G147A | silent | 142 | 17 | 21 (vs. V9) |
| | G558T | silent | | | |
| | A640G | N214D | | | |
| | C1214G | T405R | | | |
| | A1286G | N429S | | | |
| V14 | G147A | silent | 143 | 18 | 48 (vs. V9) |
| | G558T | silent | | | |
| | A640G | N214D | | | |
| | G726A | silent | | | |
| | C874A | Q292K | | | |
| | C1214G | T405R | | | |
| V15 | G126A | Silent | 144 | 19 | 17 (vs. V9) |
| | G147A | silent | | | |
| | T179G | V60G | | | |
| | C507T | silent | | | |
| | G558T | silent | | | |
| | A640G | N214D | | | |
| | C1214G | T405R | | | |
| V16 | G147A | silent | 145 | 20 | 30 (vs. V12) |
| | G178A | V60I | | | |
| | G558T | silent | | | |
| | T588C | silent | | | |
| | A640G | N214D | | | |
| | T808C | Silent | | | |
| | G1033A | A345T | | | |
| | C1214G | T405R | | | |
| | A1285G | N429G | | | |
| | A1286G | " | | | |
| V17 | G147A | silent | 146 | 21 | 21 (vs. V16) |
| | G178A | V60I | | | |
| | G558T | silent | | | |
| | T588C | silent | | | |
| | T635G | M212R | | | |
| | A640G | N214D | | | |
| | T661G | Y221V | | | |
| | A662T | " | | | |
| | T808C | silent | | | |
| | G1033A | A345T | | | |
| | C1214G | T405R | | | |
| | A1285G | N429G | | | |
| | A1286G | " | | | |

Table 8 below sets forth the fermentation titer in g/L for wildtype CVS and several CVS variants identified above for fermentation in 3 L fermentors. For each experiment, the variants were expressed in CALI5-1 and fermentation conditions were identical. Accordingly, the differences observed in valencene fermentation yields within an individual experiment can be attributed to differences in the valencene synthase genes being expressed. As is shown in Table 8, all CVS variants produced an increased amount of valencene as compared to wildtype CVS.

TABLE 8

| Comparison of valencene production | | | |
|---|---|---|---|
| Expt | CVS Variant | Amino Acid Changes | Fermentation Titer, g/L |
| 1 | wt | | 0.079 |
| | V1 | N214D, S473Y | 0.097 |
| | V2 | T405R | 0.068 |
| | V9 | N214D, T405R | 0.200 |
| 2 | wt | | 0.142 |
| | V1 | N214D, S473Y | 0.384 |
| | V9 | N214D, T405R | 0.518 |
| 3 | wt | | 0.212 |
| | V1 | N214D, S473Y | 0.416 |
| | V9 | N214D, T405R | 0.517 |
| 4 | wt | | 0.187 |
| | V9 | N214D, T405R | 0.779 |
| | V10 | N214D, A345V, T405R, D536E | 0.644 |
| | V12 | V60I, N214D, A345T, T405R | 0.858 |
| 5 | V9 | N214D, T405R | 0.741 |
| | V12 | V60I, N214D, A345T, T405R | 0.904 |
| 6 | V12 | V60I, N214D, A345T, T405R | 0.981 |
| | V17 | V60I, M212R, N214D, Y221V, A345T, T405R, N429G | 1.59 |

The increased valencene production by yeast transformants containing the mutant valencene synthase genes indicated that mutations at amino acid positions 60, 97, 209, 212, 214, 221, 238, 292, 333, 345, 369, 405, 429, 473 and 536, alone or in combination, are either tolerated or result in improved valencene production. Some of these positions were identified multiple times in independent variants. For example, the valine at position 60 of the wild type enzyme has been substituted with isoleucine in variant V12 or glycine in variant V15; the alanine at position 345 has been substituted with either threonine in variant V12 or valine in variant V3; and tyrosine at position 221 has been substituted with either cysteine in variant V4 or valine in variant V17. Positions 60, 97, 209, 212, 214, 221, and 238 are situated in the non-catalytic domain of the enzyme with homology to glycosyl hydrolases.

B. Generation of Valencene Synthase Mutants with Combinations of Mutations

Amino acid alterations identified in Example 3.A, above, and in similar error prone PCR experiments as described above, were combined in a single enzyme. Also included were mutations at positions 24, 38, 58, 88, 125, 173 and 252 of the valencene synthase set forth in SEQ ID NO:2, which, according to a model of the three dimensional structure of valencene synthase, are on the surface of the protein. Two variant enzymes were synthesized, each with 29 amino acid changes. Variants CVS V18 (SEQ ID NO:3) and CVS V19 (SEQ ID NO:4) each contained 22 mutations that were previously identified by error-prone PCR as having beneficial or neutral effects on enzyme activity, and also seven mutations in surface residues. V18 contained mutations of each of the surface residues to alanine, and V19 contained mutation of each of the surface residues to glutamine or asparagine. Table 9 sets forth the amino acid residues at the targeted positions. Table 10 sets forth the amino acid and nucleotide changes in CVS V19 as compared to wildtype CVS. Table 11 sets forth the silent nucleotide changes in codon-optimized CVS V19 (SEQ ID NO:129) as compared to wildtype CVS (SEQ ID NO:1).

Codon-optimized CVS V18 (SEQ ID NO:128) and CVS V19 (SEQ ID NO:129) genes were cloned into the YEp-CVS-ura plasmid and transformed into ALX11-30 *S. cerevisiae*. Valencene production by each of the transformants was assessed following fermentation, as described in Example 2 above. Each of the transformants produced valencene at levels comparable to the variant V12. While valencene production by variant V12 was conducted in CALI5-1 cells, the production in ALX7-95 cells is expected to be similar as the only difference in the two strains is in the presence of a leu marker. Each of the transformants also produced valencene with approximately 10-fold greater titer than ALX7-95 *S. cerevisiae* expressing the wildtype valencene synthase. Typically, production of valencene by mutants is 10 to 20 times the production level of wildtype CVS.

TABLE 9

| Variant amino acids of CVS V18 and CVS V19 | | | |
|---|---|---|---|
| Amino Acid | Amino Acid Residue | | |
| Position | CVS wt | CVS V18 | CVS V19 |
| 24 | K | A | Q |
| 38 | Q | A | N |
| 58 | K | A | Q |
| 60 | V | I | I |
| 88 | K | A | Q |
| 93 | Y | H | H |
| 97 | N | D | D |
| 98 | R | K | K |
| 125 | K | A | Q |
| 173 | K | A | Q |
| 184 | K | R | R |
| 209 | F | I | I |
| 212 | M | R | R |
| 214 | N | D | D |
| 219 | H | D | D |
| 221 | Y | V | V |
| 238 | E | D | D |
| 252 | K | A | Q |
| 292 | Q | K | K |
| 321 | Q | A | A |
| 333 | E | D | D |
| 345 | A | T | T |
| 369 | N | I | I |
| 377 | S | Y | Y |
| 405 | T | R | R |
| 429 | N | G | G |
| 436 | A | S | S |
| 501 | T | P | P |
| 536 | D | E | E |

TABLE 10

| CVS V19 amino acid mutations and corresponding nucleotide changes versus wildtype CVS | | |
|---|---|---|
| Mutant | Amino Acid Mutations | Nucleotide Changes vs wildtype CVS |
| V19 | K24Q | AAA→CAA |
| | Q38N | CAA→AAT |
| | K58Q | AAG→CAA |
| | V60I | GTT→ATT |
| | K88Q | AAA→CAA |
| | Y93H | TAT→CAT |
| | N97D | AAT→GAT |
| | R98K | AGA→AAA |
| | K125Q | AAG→CAA |
| | K173Q | AAG→CAA |
| | K184R | AAG→AGA |
| | F209I | TTT→ATT |
| | M212R | ATG→AGA |
| | N214D | AAT→GAT |
| | H219D | CAT→GAT |
| | Y221V | TAC→GTT |
| | E238D | GAG→GAT |
| | K252Q | AAA→CAA |
| | Q292K | CAA→AAA |
| | Q321A | CAA→GCT |

TABLE 10-continued

CVS V19 amino acid mutations and corresponding nucleotide changes versus wildtype CVS

| Mutant | Amino Acid Mutations | Nucleotide Changes vs wildtype CVS |
|---|---|---|
| | E333D | GAA→GAT |
| | A345T | GCT→ACA |
| | N369I | AAT→ATT |
| | S377Y | TCT→TAC |
| | T405R | ACA→AGA |
| | N429G | AAT→GGT |
| | A436S | GCA→TCT |
| | T501P | ACC→CCA |
| | D536E | GAT→GAA |

TABLE 11

Synonymous Nucleotide changes in codon optimized CVS V19

| Mutant | Mutations | Nucleotide Changes vs wildtype CVS |
|---|---|---|
| V19 | S2S | TCG→TCA |
| | G4G | GGA→GGT |
| | T6T | ACA→ACT |
| | R8R | CGT→AGA |
| | P9P | CCT→CCA |
| | A11A | GCA→GCT |
| | F13F | TTC→TTT |
| | P15P | CCT→CCA |
| | S16S | AGT→TCT |
| | L17L | TTA→TTG |
| | N20N | AAC→AAT |
| | F22F | TTC→TTT |
| | L23L | CTC→TTG |
| | A26A | GCT→GCA |
| | S27S | TCT→TCA |
| | F29F | TTC→TTT |
| | T31T | ACA→ACT |
| | T35T | ACT→ACA |
| | A36A | GCA→GCT |
| | T37T | ACT→ACA |
| | R40R | CGA→AGA |
| | H41H | CAC→CAT |
| | E42E | GAG→GAA |
| | A43A | GCA→GCT |
| | L44L | CTG→TTG |
| | K45K | AAA→AAG |
| | E47E | GAG→GAA |
| | V48V | GTA→GTT |
| | R49R | AGG→AGA |
| | I52I | ATA→ATT |
| | T53T | ACA→ACT |
| | A55A | GCT→GCA |
| | P59P | CCT→CCA |
| | Q61Q | CAG→CAA |
| | K62K | AAG→AAA |
| | L63L | TTA→TTG |
| | R64R | CGC→AGA |
| | V69V | GTA→GTT |
| | R71R | CGC→AGA |
| | L72L | CTG→TTG |
| | G73G | GGG→GGT |
| | V74V | GTG→GTT |
| | Y76Y | TAT→TAC |
| | H77H | CAC→CAT |
| | E79E | GAG→GAA |
| | I82I | ATA→ATT |
| | A85A | GCA→GCT |
| | I86I | ATA→ATT |
| | L89L | TTA→TTG |
| | I92I | ATC→ATT |
| | D95D | GAC→GAT |
| | S96S | AGT→TCT |
| | L101L | CTC→TTG |

TABLE 11-continued

Synonymous Nucleotide changes in codon optimized CVS V19

| Mutant | Mutations | Nucleotide Changes vs wildtype CVS |
|---|---|---|
| | H102H | CAC→CAT |
| | T103T | ACC→ACT |
| | S105S | TCC→TCT |
| | L106L | CTT→TTG |
| | F108F | TTT→TTC |
| | R109R | CGA→AGA |
| | L111L | CTT→TTG |
| | R112R | AGG→AGA |
| | Q113Q | CAG→CAA |
| | G115G | GGA→GGT |
| | I116I | ATC→ATT |
| | S119S | TCA→TCT |
| | V122V | GTG→GTT |
| | F123F | TTT→TTC |
| | E124E | GAG→GAA |
| | F126F | TTC→TTT |
| | K127K | AAA→AAG |
| | E130E | GAG→GAA |
| | K134K | AAG→AAA |
| | S135S | TCA→AGT |
| | S136S | TCG→TCT |
| | I138I | ATA→ATT |
| | N139N | AAC→AAT |
| | G143G | GGG→GGC |
| | L145L | TTA→TTG |
| | S146S | AGT→TCT |
| | Y148Y | TAC→TAT |
| | E149E | GAG→GAA |
| | A150A | GCA→GCT |
| | A151A | GCA→GCT |
| | Y152Y | TAC→TAT |
| | A154A | GCA→GCT |
| | R156R | CGC→AGA |
| | G157G | GGA→GGT |
| | I160I | ATA→ATT |
| | L161L | TTA→TTG |
| | A164A | GCC→GCT |
| | A166A | GCT→GCA |
| | F167F | TTC→TTT |
| | T169T | ACC→ACT |
| | H171H | CAC→CAT |
| | L172L | CTG→TTG |
| | V176V | GTA→GTT |
| | A177A | GCT→GCA |
| | Q178Q | CAG→CAA |
| | V181V | GTA→GTT |
| | T182T | ACC→ACT |
| | P183P | CCT→CCA |
| | L185L | CTT→TTG |
| | A186A | GCG→GCT |
| | Q188Q | CAG→CAA |
| | I189I | ATA→ATT |
| | N190N | AAT→AAC |
| | L193L | TTA→TTG |
| | Y194Y | TAC→TAT |
| | R195R | CGT→AGA |
| | P196P | CCT→CCA |
| | L197L | CTT→TTG |
| | R198R | CGT→AGA |
| | T200T | ACC→ACT |
| | L201L | CTA→TTG |
| | L204L | TTA→TTG |
| | E205E | GAG→GAA |
| | A206A | GCG→GCA |
| | R207R | AGG→AGA |
| | Y208Y | TAT→TAC |
| | S211S | TCC→TCA |
| | I213I | ATC→ATT |
| | S215S | TCA→TCT |
| | T216T | ACA→ACT |
| | S217S | AGT→TCT |
| | L220L | TTA→TTG |
| | N222N | AAT→AAC |
| | K223K | AAA→AAG |

TABLE 11-continued

| Synonymous Nucleotide changes in codon optimized CVS V19 | | |
|---|---|---|
| Mutant | Mutations | Nucleotide Changes vs wildtype CVS |
| | L225L | CTG→TTG |
| | L226L | CTG→TTA |
| | F228F | TTT→TTC |
| | A229A | GCA→GCT |
| | L231L | TTA→TTG |
| | F233F | TTT→TTC |
| | N234N | AAC→AAT |
| | I235I | ATA→ATT |
| | L237L | CTA→TTG |
| | L239L | CTG→TTG |
| | H240H | CAC→CAT |
| | K241K | AAG→AAA |
| | E242E | GAG→GAA |
| | L244L | CTC→TTG |
| | N245N | AAT→AAC |
| | L247L | TTA→TTG |
| | T248T | ACA→ACT |
| | K249K | AAG→AAA |
| | L254L | TTA→TTG |
| | D255D | GAC→GAT |
| | F256F | TTG→TTT |
| | T258T | ACA→ACT |
| | L260L | CTA→TTG |
| | P261P | CCT→CCA |
| | A263A | GCA→GCT |
| | D265D | GAC→GAT |
| | L267L | TTA→TTG |
| | V268V | GTG→GTT |
| | E269E | GAG→GAA |
| | L270L | TTA→TTG |
| | Y271Y | TAT→TAC |
| | L275L | TTA→TTG |
| | G276G | GGG→GGT |
| | T277T | ACA→ACT |
| | Y278Y | TAC→TAT |
| | F279F | TTC→TTT |
| | E280E | GAG→GAA |
| | P281P | CCT→CCA |
| | Y283Y | TAT→TAC |
| | A284A | GCA→GCT |
| | G286G | GGG→GGT |
| | K288K | AAG→AAA |
| | I289I | ATA→ATC |
| | T291T | ACC→ACT |
| | L293L | TTA→TTG |
| | N294N | AAT→AAC |
| | I296I | ATA→ATT |
| | L297L | TTA→TTG |
| | I299I | ATC→ATT |
| | I300I | ATA→ATT |
| | T303T | ACT→ACC |
| | Y304Y | TAT→TAC |
| | A306A | GCG→GCT |
| | Y307Y | TAT→TAC |
| | T309T | ACA→ACT |
| | L310L | CTT→TTG |
| | L313L | CTC→TTG |
| | S314S | AGC→TCT |
| | L315L | CTC→TTG |
| | F316F | TTT→TTC |
| | T317T | ACT→ACC |
| | A319A | GCA→GCT |
| | R322R | AGA→CGT |
| | N324N | AAT→AAC |
| | E326E | GAG→GAA |
| | A327A | GCC→GCT |
| | V328V | GTA→GTT |
| | D329D | GAT→GAC |
| | L331L | CTT→TTG |
| | Y334Y | TAC→TAT |
| | K336K | AAA→AAG |
| | L337L | TTG→TTA |
| | I338I | ATT→ATC |
| | R340R | AGG→AGA |

TABLE 11-continued

| Synonymous Nucleotide changes in codon optimized CVS V19 | | |
|---|---|---|
| Mutant | Mutations | Nucleotide Changes vs wildtype CVS |
| | T341T | ACA→ACT |
| | L342L | CTC→TTG |
| | L343L | TTA→TTG |
| | F346F | TTT→TTC |
| | N347N | AAT→AAC |
| | I349I | ATT→ATA |
| | E350E | GAG→GAA |
| | E351E | GAA→GAG |
| | A354A | GCC→GCT |
| | K355K | AAG→AAA |
| | G357G | GGA→GGT |
| | S359S | TCA→TCT |
| | H360H | CAC→CAT |
| | C361C | TGC→TGT |
| | R363R | CGT→AGA |
| | Y364Y | TAT→TAC |
| | A365A | GCA→GCT |
| | E367E | GAG→GAA |
| | E368E | GAG→GAA |
| | K371K | AAA→AAG |
| | V372V | GTA→GTT |
| | G374G | GGA→GGT |
| | A375A | GCA→GCT |
| | Y376Y | TAC→TAT |
| | A380A | GCC→GCT |
| | K381K | AAA→AAG |
| | F383F | TTC→TTT |
| | S384S | AGT→TCT |
| | Y387Y | TAC→TAT |
| | V388V | GTT→GTC |
| | P389P | CCA→CCT |
| | T390T | ACA→ACT |
| | E392E | GAG→GAA |
| | E393E | GAG→GAA |
| | Y394Y | TAT→TAC |
| | P396P | CCT→CCA |
| | A398A | GCA→GCT |
| | L399L | CTA→TTG |
| | T400T | ACA→ACT |
| | S401S | AGT→TCT |
| | C402C | TGT→TGC |
| | F406F | TTC→TTT |
| | V407V | GTC→GTT |
| | I408I | ATA→ATT |
| | T409T | ACA→ACC |
| | S411S | TCC→TCT |
| | F412F | TTC→TTT |
| | L413L | CTT→TTG |
| | G414G | GGC→GGT |
| | F418F | TTT→TTC |
| | A419A | GCA→GCT |
| | T420T | ACT→ACA |
| | K421K | AAA→AAG |
| | E422E | GAG→GAA |
| | V423V | GTT→GTA |
| | F424F | TTT→TTC |
| | I427I | ATC→ATT |
| | S428S | TCC→TCT |
| | N430N | AAC→AAT |
| | P431P | CCT→CCA |
| | K432K | AAG→AAA |
| | V434V | GTA→GTT |
| | A437A | GCA→GCT |
| | S438S | TCA→TCT |
| | I440I | ATC→ATT |
| | C441C | TGC→TGT |
| | L443L | CTC→TTG |
| | D445D | GAT→GAC |
| | D446D | GAC→GAT |
| | G449G | GGT→GGA |
| | H450H | CAT→CAC |
| | E451E | GAG→GAA |
| | E453E | GAG→GAA |
| | Q454Q | CAG→CAA |

TABLE 11-continued

| Synonymous Nucleotide changes in codon optimized CVS V19 | | |
|---|---|---|
| Mutant | Mutations | Nucleotide Changes vs wildtype CVS |
| | K455K | AAG→AAA |
| | G457G | GGA→GGT |
| | H458H | CAT→CAC |
| | A460A | GCG→GCA |
| | S461S | TCA→TCT |
| | A462A | GCT→GCA |
| | C465C | TGT→TGC |
| | Y466Y | TAC→TAT |
| | T467T | ACG→ACT |
| | K468K | AAG→AAA |
| | Q469Q | CAG→CAA |
| | V472V | GTC→GTT |
| | S473S | TCT→TCC |
| | A477A | GCA→GCT |
| | I478I | ATT→ATC |
| | K479K | AAA→AAG |
| | F481F | TTT→TTC |
| | E482E | GAA→GAG |
| | E484E | GAA→GAG |
| | A486A | GCA→GCT |
| | N487N | AAT→AAC |
| | A488A | GCA→GCT |
| | K490K | AAA→AAG |
| | I492I | ATT→ATC |
| | N493N | AAC→AAT |
| | E494E | GAG→GAA |
| | E495E | GAG→GAA |
| | L496L | TTG→TTA |
| | K499K | AAG→AAA |
| | V502V | GTC→GTT |
| | A504A | GCC→GCT |
| | R505R | CGA→AGA |
| | L507L | CTG→TTG |
| | L508L | CTC→TTA |
| | G509G | GGG→GGT |
| | T510T | ACG→ACT |
| | L512L | CTT→TTG |
| | L514L | CTT→TTG |
| | R516R | CGT→AGA |
| | A517A | GCA→GCT |
| | I518I | ATT→ATC |
| | I521I | ATT→ATC |
| | Y522Y | TAC→TAT |
| | E524E | GAG→GAA |
| | D525D | GAC→GAT |
| | G527G | GGC→GGT |
| | Y528Y | TAT→TAC |
| | T529T | ACG→ACT |
| | Y532Y | TAC→TAT |
| | L533L | CTA→TTG |
| | K535K | AAA→AAG |
| | I538I | ATT→ATA |
| | A539A | GCT→GCA |
| | V541V | GTG→GTT |
| | L542L | CTA→TTG |
| | G543G | GGA→GGT |
| | D544D | GAC→GAT |
| | H545H | CAC→CAT |

C. Saturation Mutagenesis of CVS V18 and V19

The CVS V18 gene was subjected to saturation mutagenesis of various residues of the N-terminal domain and a portion of the C-terminal catalytic domain (amino acids 267-462) to identify amino acids that were amenable to alteration, providing either positive or neutral effects on activity, as measured by productivity of valencene. Following mutagenesis, plasmid DNA containing the mutant genes was transformed into *Saccharomyces cerevisiae* strain ALX7-95. Transformant colonies were then screened for valencene production. Plasmid DNA from transformants that exhibited valencene production of greater than 110% than the valencene production from transformants containing the CVS V18 gene were then sequenced.

1. Mutagenesis

Overlapping PCR was used to generate mutations at various positions of the gene. For each position to be mutated, a pair of complementary mutagenic primers was synthesized, each containing 15 base pairs of homology on each side of the amino acid position to be mutated and random nucleotides at the codon targeted for mutagenesis.

Mutagenic primers for the desired codon change were used in PCR reactions with either the upstream primer 11-157.7 (5'-AAGGTACCATTTAAAAAAATGTC-3'; SEQ ID NO:297) or the downstream primer 11-157.8 (5'-TTTCTCTAGATTAAAATGGAACA-3'; SEQ ID NO:298) to generate two PCR products, each containing random nucleotides at the desired codon. The two PCR fragments were joined using an overlapping PCR reaction, in which the two fragments were mixed in equal molar ratios and subjected to 5 cycles of PCR amplification without primers. PCR conditions were one cycle at 96° C. for 2 minutes and then 5 cycles of 94° C. for 30 seconds, 38° C. for 30 seconds, and 72° C. for 2 minutes. Twenty to thirty additional cycles were then performed under the same PCR conditions in the presence of primers 11-157.7 and 11-157.8.

The PCR reactions were ethanol precipitated by mixing 0.1 volumes of 3M sodium acetate (pH 4.8) and two volumes of 100% ethanol and spinning in a microfuge for 15 minutes. The resulting DNA pellet was washed with 70% ethanol. The DNA was dissolved in 16 μL milli Q purified water before being combined with 1 μL KpnI, 1 μL XbaI and 2 μL 10× digestion buffer. The digestion reaction was then incubated at 37° C. After completion, the restriction digest was run on a 1 agarose gel and the 1.6 kb fragment was excised from the gel. The DNA was then eluted using a Freeze n Squeeze elution column (Bio-Rad). The DNA fragment was ligated into the KpnI and XbaI sites of YEp-CVS-ura, and the resulting plasmid was electroporated into DH10B *E. coli* cells (Invitrogen). A tenth of the volume of transformation culture was plated on LB ampicillin plates (100 μg/mL), and the remaining cells were inoculated into liquid LB ampicillin (100 μg/mL) for preparation of plasmid DNA. The plates and cultures were grown overnight at 37° C. For those transformations that had greater than 200 colonies on the LB ampicillin plate, 3 ml of the LB culture was centrifuged for extraction of plasmid DNA. Each resulting plasmid DNA preparation contained a pool of mutant genes, with each pool having random mutations in nucleotides at the same, single codon.

The plasmid DNA from each pool was transformed into *Saccharomyces cerevisiae* strain ALX7-95 using a lithium acetate yeast transformation kit from Sigma-Aldrich. Transformants were selected on SDE agar medium (0.67% Bacto yeast nitrogen base without amino acids, 2% glucose, 0.14% yeast synthetic drop-out medium without uracil, leucine, histidine, tryptophan, 40 mg/L ergosterol) after three days growth at 28-30° C.

2. Screening

To screen transformants for valencene production, a high-throughput screening procedure using microvial cultures was employed. Transformant yeast colonies were inoculated into individual wells of 96-well microtiter plates filled with 200 μL of SDE. The plate was grown for two to three days at 28° C. After growth to saturation, 10 μL from each well was used to inoculate 2 mL glass vials containing 250 μL of medium suitable for growth and valencene production. The vials were sealed with serum-stoppered caps and then incubated with shaking for two to three days at 28° C. The products were extracted first by introducing 250 μL of acetone through the serum stopper and vortexing, followed by addition of 500 μL of n-hexane and vortexing. After phase separation, the vials were placed on the sample tray of a gas chromatography autosampler, which removed one microliter of the organic phase for analysis of sesquiterpenes. The acetone and hexane used for extraction were each spiked with internal standards to aid in quantitation of the samples. The extracted samples were analyzed by gas chromatography and the amount of valencene was calculated from the peak area.

Those mutants that produced >110% valencene relative to CVS V18 were also screened in shake flasks. A 10 mL seed culture in SDE medium was grown for 24 hr, and 2.5 mL was used to inoculate 50 mL fermentation medium (2% ammonium sulfate, 2% potassium phosphate, 0.1% NaCl, 0.6% $MgSO_4.7H_2O$, 0.4% yeast extract, 1 mL mineral solution [$FeSO_4.7H_2O$ 0.028%, $ZnSO_4.7H_2O$ 0.029%, $CuSO_4.5H_2O$ 0.008%, $Na_2MoO_4.2H_2O$ 0.024%, $CoCl_2.6H_2O$ 0.024%, $MnSO_4.H_2O$ 0.017%, HCl 1 mL], 0.5 ml 50% glucose, 1.5 ml vitamin solution [biotin 0.001%, Ca-pantothenate 0.012%, inositol 0.06%, pyridoxine-HCl 0.012%, thiamine-HCl 0.012%], 0.5 ml 10% $CaCl_2$) in a 250 unbaffled flask. The cultures were grown at 28° C. After 16 hr of incubation, the cultures were fed 3.6 ml 50% glucose and 0.667 ml 12.5% yeast extract. Feeding occurred every 24 after the initial feed. The pH of the cultures was adjusted to 4.5 every 24 hrs with the addition of 30% NaOH. After approximately 88 hours of incubation, 0.1 ml of IGEPAL CA-630 was added and the culture was incubated with shaking to fully emulsify the vegetable oil. After 30 minutes, a 2 mL culture sample was taken. The sample was extracted with 2 mL acetone/cedrene solution and then extracted with 4 mL hexane/hexadecane solution. An aliquot was analyzed by GC and the amount of valencene was determined.

3. Results a. Initial Screen for Tolerance for Mutation

Table 12 below provides a summary of amino acid positions and their general tolerance for mutation, as determined by their valencene production. Table 12 sets forth the position of the mutated amino acid, the secondary structure present for each amino acid and the percentage of samples that produced <30% valencene and >90% valencene, as compared to the percentage of valencene produced by parent CVS V18. Amino acid positions where ≥50% of the samples produced <30% or >90% valencene, as compared to the parent CVS V18, are highlighted. For example, at amino acid position 271, 72 of 96 samples tested (75%) produced <30% valencene and 3 of 96 samples tested (3.13%) produced >90% valencene, as compared to the production of valencene by parent CVS V18. This position was therefore considered invariant or nearly invariant. In contrast, at amino acid position 282, 91.56% of samples (88 samples) produced >90% valencene, as compared to parent CVS V18, with only 4.17% producing <30% valencene. This position was considered moderately tolerant to change. Thus, as shown in Table 12 below, amino acid positions 267, 269, 270, 271, 273, 295, 298, 301, 302, 303, 305, 306, 312, 403, 404, 407, 442, 445 and 446 have a large proportion of variants with low activity, and these positions were considered to be relatively invariant. In contrast, amino acid positions 92, 166, 171, 184, 202, 218, 281, 282, 293, 320, 333, 337, 344, 347, 352, 353, 355, 357, 360, 361, 362, 363, 364, 366, 367, 386, 415 and 428 have a large proportion of variants with high activity, and these positions were considered to be particularly tolerant to change.

TABLE 12

Saturation Mutagenesis Screen

| Secondary Structure | Amino Acid | % of samples with <30% valencene production (as compared to CVS V18) | % of samples with >90% valencene production (as compared to CVS V18) |
|---|---|---|---|
| non-helical | 92 | 9.38 | 83.33 |
| Alpha Helix 4 | 102 | 7.29 | 34.38 |
| Alpha Helix 5 | 151 | 17.71 | 45.83 |
| Alpha Helix 6 | 166 | 12.50 | 83.33 |
| | 171 | 10.42 | 71.88 |
| | 172 | 0.00 | 27.08 |
| Unstructured | 178 | 54.17 | 22.92 |
| Loop 7 | 179 | 7.29 | 66.67 |
| | 184 | 7.29 | 88.54 |
| Alpha Helix 7 | 190 | 8.33 | 43.75 |
| | 191 | 7.29 | 42.71 |
| Unstructured Loop 8 | 195 | 9.38 | 7.29 |
| Alpha Helix 8 | 202 | 12.50 | 76.04 |
| | 203 | 57.29 | 22.92 |
| | 207 | 15.63 | 66.67 |
| Unstructured Loop 9 | 218 | 16.67 | 72.92 |
| Alpha Helix C | 267 | 76.04 | 8.33 |
| | 267 | 80.21 | 8.33 |
| | 269 | 78.13 | 13.54 |
| | 270 | 83.33 | 11.46 |
| | 271 | 86.46 | 3.13 |
| | 271 | 75.00 | 3.13 |
| | 272 | 31.25 | 54.17 |
| | 273 | 71.88 | 23.96 |
| | 274 | 18.75 | 67.71 |
| | 274 | 20.83 | 69.79 |
| | 275 | 32.29 | 43.75 |
| | 275 | 33.33 | 36.46 |
| | 276 | 36.46 | 9.38 |
| | 276 | 36.46 | 9.38 |
| Unstructured | 277 | 50.00 | 4.17 |
| Loop 11 | 277 | 25.00 | 53.13 |
| | 278 | 30.21 | 10.42 |
| | 278 | 19.79 | 4.17 |
| | 279 | 21.88 | 54.17 |
| | 281 | 7.29 | 88.54 |
| | 282 | 4.17 | 91.67 |
| Alpha Helix D | 284 | 12.50 | 40.63 |
| | 287 | 68.75 | 14.58 |
| | 288 | 12.50 | 25.00 |
| | 289 | 10.42 | 50.00 |
| | 290 | 6.25 | 55.21 |
| | 291 | 27.08 | 17.71 |
| | 292 | 9.38 | 69.79 |
| | 293 | 8.33 | 77.08 |
| | 294 | 41.67 | 2.08 |
| | 295 | 79.17 | 4.17 |
| | 296 | 6.25 | 64.58 |
| | 297 | 45.83 | 9.38 |
| | 298 | 82.29 | 4.17 |
| | 299 | 16.67 | 47.92 |
| | 300 | 23.96 | 23.96 |
| | 301 | 92.71 | 5.21 |
| | 302 | 87.50 | 9.38 |
| | 303 | 79.17 | 10.42 |
| | 305 | 91.67 | 6.25 |

TABLE 12-continued

| | | | |
|---|---|---|---|
| Unstructured Loop 12 | 306 | 73.96 | 12.50 |
| Alpha Helix D1 | 310 | 10.42 | 65.63 |
| | 311 | 17.71 | 65.63 |
| | 312 | 83.33 | 9.38 |
| | 313 | 23.96 | 61.46 |
| | 314 | 17.71 | 40.63 |
| | 315 | 9.38 | 61.46 |
| | 316 | 21.88 | 62.50 |
| | 317 | 8.33 | 44.79 |
| | 318 | 27.08 | 23.96 |
| | 319 | 10.42 | 30.21 |
| | 320 | 11.46 | 75.00 |
| | 321 | 9.38 | 64.58 |
| | 322 | 8.33 | 48.96 |
| Unstructured Loop 13 | 324 | 18.75 | 58.33 |
| | 331 | 8.33 | 13.54 |
| | 332 | 8.33 | 32.29 |
| Alpha Helix E | 333 | 13.54 | 77.08 |
| | 334 | 33.33 | 9.38 |
| | 335 | 13.54 | 42.71 |
| | 336 | 9.38 | 63.54 |
| | 337 | 8.33 | 79.17 |
| | 338 | 38.54 | 16.67 |
| | 339 | 9.38 | 63.54 |
| | 340 | 16.67 | 27.08 |
| | 341 | 13.54 | 48.96 |
| | 342 | 20.83 | 52.08 |
| | 343 | 6.25 | 67.71 |
| | 344 | 0.00 | 87.50 |
| | 345 | 9.38 | 45.83 |
| | 346 | 21.88 | 45.83 |
| | 347 | 12.50 | 78.13 |
| | 348 | 17.71 | 63.54 |
| | 349 | 11.46 | 32.29 |
| | 350 | 15.63 | 73.96 |
| | 351 | 20.83 | 52.08 |
| Unstructured Loop 15 | 352 | 10.42 | 70.83 |
| | 353 | 9.38 | 83.33 |
| | 354 | 7.29 | 31.25 |
| | 355 | 10.42 | 78.13 |
| | 356 | 11.46 | 41.67 |
| | 357 | 12.50 | 72.92 |
| | 358 | 12.50 | 50.00 |
| | 359 | 13.54 | 52.08 |
| | 360 | 11.46 | 76.04 |
| | 361 | 6.25 | 83.33 |
| | 362 | 9.38 | 78.13 |
| Alpha Helix F | 363 | 9.38 | 84.38 |
| | 364 | 9.38 | 73.96 |
| | 365 | 17.71 | 59.38 |
| | 366 | 9.38 | 86.46 |
| | 367 | 5.21 | 91.67 |
| | 368 | 16.67 | 37.50 |
| | 369 | 7.29 | 54.17 |
| | 370 | 15.63 | 37.50 |
| | 371 | 10.42 | 42.71 |
| | 372 | 37.50 | 33.33 |
| | 373 | 11.46 | 67.71 |
| | 375 | 19.79 | 29.17 |
| | 377 | 17.71 | 53.13 |
| | 378 | 12.50 | 52.08 |
| | 380 | 22.92 | 55.21 |
| | 381 | 12.50 | 64.28 |
| | 382 | 47.92 | 22.92 |
| Unstructured Loop 16 | 386 | 13.54 | 79.17 |
| | 387 | 16.67 | 4.17 |
| | 388 | 20.83 | 21.88 |
| | 389 | 25.00 | 19.79 |
| | 390 | 13.54 | 36.46 |
| Alpha Helix G1 | 391 | 15.63 | 42.71 |
| | 392 | 13.54 | 68.75 |
| | 393 | 11.46 | 21.88 |
| | 394 | 67.71 | 11.46 |
| | 395 | 12.50 | 42.71 |
| Unstructured Loop 17 | 397 | 20.83 | 51.04 |
| | 398 | 61.46 | 5.21 |
| | 399 | 18.75 | 63.54 |
| | 400 | 14.58 | 45.83 |
| | 401 | 67.71 | 12.50 |
| | 402 | 58.33 | 4.17 |
| | 403 | 70.83 | 16.67 |
| | 404 | 85.42 | 4.17 |
| Alpha Helix G2 | 405 | 23.96 | 10.42 |
| | 406 | 26.04 | 9.38 |
| | 407 | 70.83 | 3.13 |
| | 408 | 55.21 | 8.33 |
| | 409 | 17.71 | 41.67 |
| | 410 | 25.00 | 20.83 |
| | 411 | 41.67 | 27.08 |
| | 412 | 9.38 | 54.17 |
| | 413 | 13.54 | 34.38 |
| Unstructured Loop 18 | 415 | 7.29 | 75.00 |
| Alpha Helix H1 | 422 | 31.25 | 58.33 |
| | 423 | 7.29 | 63.54 |
| | 428 | 4.17 | 85.42 |
| Unstructured Loop 19 | 429 | 11.46 | 45.83 |
| Alpha Helix H2 | 434 | 19.79 | 51.04 |
| | 435 | 9.38 | 50.00 |
| | 438 | 30.21 | 20.83 |
| | 439 | 19.79 | 29.17 |
| | 440 | 46.88 | 26.04 |
| | 441 | 62.50 | 21.88 |
| | 442 | 73.96 | 12.50 |
| | 443 | 17.71 | 57.29 |
| | 444 | 15.63 | 47.92 |
| | 445 | 78.13 | 10.42 |
| | 446 | 75.00 | 14.58 |
| | 447 | 9.38 | 65.63 |
| Unstructured Loop 20 | 449 | 66.67 | 15.63 |
| Alpha Helix H3 | 451 | 28.13 | 38.54 |
| | 452 | 48.96 | 28.13 |
| | 454 | 53.13 | 21.88 |
| Unstructured Loop 21 | 457 | 67.71 | 11.46 |

b. Further Analysis of Invariant and Tolerant Amino Acids

In order to determine the overall effectiveness of the randomization, 19 independent bacterial clones mutated at amino acid 270 were randomly selected and sequenced to identify the mutations. Of these 19 independent bacterial isolates, none retained the original codon. Two isolates encoded wildtype amino acid leucine by a changed codon (silent mutation), and one isolate had a stop codon at amino acid 270. The remaining clones encoded various other amino acids.

Individual mutant isolates at amino acid residue 270, an amino acid that was determined to be invariant or nearly invariant, were further analyzed. As shown in the Table above, only 11.46% of isolates at amino acid 270 produced more than 30% valencene, as compared to parent CVS V18 levels. Two of these samples were the two CVS V18 controls. Thus, only 10 of 94 mutant samples (10.63%) produced a significant level of valencene. These isolates, plus one non-valencene producing isolate, were subjected to DNA sequencing of their mutant plasmids. Nine (9) of the valencene producing isolates encoded leucine, although the original codon had been mutated from TTG to CTC, CTA, CTT or TTA. The only other valencene producing isolate encoded wildtype Leu270, but had a mutation at amino acid 269, due to an apparent error within the DNA primer sequence or introduced during PCR amplification. The valencene non-producing isolate that was sequenced contained the mutation L270E.

Individual mutant isolates from five amino acid positions that were identified as moderately tolerant to change in the saturation mutagenesis screen were analyzed further. The top valencene producing mutant isolates identified for amino acid positions 274, 279, 281, 282 and 284 were regrown in microvial cultures and their valencene production was determined as described in Example 3.C.2 above. Additionally, up to 24 independent clones were sequenced to determine the exact amino acid mutations.

Table 13 sets forth the identified mutants. Each of these mutations are present in addition to the 29 mutations present in CVS V18 (described in Example 3.B, above). The amount of valencene produced in the initial microculture and valencene production levels (from an average of 3 or more microvial cultures) relative to the levels produced by CVS V18 also are included in the table. In some instances, the wildtype amino acid codon was maintained. In other instances, the nucleic acid mutation was silent such that the amino acid sequence of resulting valencene synthase was the same as that of CVS V18. Silent mutations are indicated in italic font. In other instances, mutations were observed in addition to the targeted mutation, likely due to errors introduced during the PCR amplification.

In the initial screen, 67.71% of the 94 mutants screened at amino acid residue 274 produced >90% valencene, as compared to the production of valencene by parent CVS V18. The high number of mutants that were identified were likely the result of a lower than normal amount of valencene produced from cells transformed with the parent CVS V18 mutant. Repeat screening was performed where the amount of valencene produced from cells transformed with CVS V18 was more typical, and fewer mutants were identified. In the repeat testing, sequencing of 14 independent mutant isolates identified revealed that the only isolates that had >90% valencene production compared to the parent CVS V18 were those containing wildtype residue D274 (see, for example, mutants V84 and V92). Overall, seven different mutations were identified, with 8 of the 14 mutant isolates containing the mutations D274M, D274N or D274G.

In the initial screen, 54.17% of the 94 mutants screened at amino acid residue 279 produced >90% valencene, as compared to the production of valencene by parent CVS V18. Repeat testing and sequencing of 24 independent mutant isolates revealed that 19 of 23 repeat cultures encoding for 11 different amino acids produced >90% valencene compared to parent CVS V18.

In the initial screen, 88.54% of the 94 mutants screened at amino acid residue 281 produced >90% valencene, as compared to the production of valencene by parent CVS V18 and were considered moderately tolerant to change. Repeat testing of 20 independent mutant isolates revealed that all mutant isolates produced ≥90% valencene compared to parent CVS V18. Eleven (11) of the 20 mutant isolates contained the mutations P281A, P281L, P281S or P281K.

In the initial screen, 91.67% of the 94 mutants screened at amino acid residue 282 produced >90% valencene, as compared to the production of valencene by parent CVS V18. Sequencing of 18 independent mutant isolates revealed that 11 of the 18 mutant isolates contained the amino acid mutations Q282S, Q282A, Q282R, Q282P or Q282L.

In the initial screen, 40.63% of the 94 mutants screened at amino acid residue 284 produced >90% valencene, as compared to the production of valencene by parent CVS V18. Repeat testing and sequencing of 23 independent mutant isolates revealed that 14 or 23 repeat cultures, encoding for 11 different amino acids, produced >90% valencene compared to parent CVS V18. Three isolates encoded for wildtype amino acid A284.

TABLE 13

CVS Variants

| mutant ID | mutation(s) found vs. CVS V18 | Nucleotide changes vs. CVS V18 | Initial microculture (mg/L) | Valencene production % vs V18 |
|---|---|---|---|---|
| V80 | D274M | GAT→ATG | 27.64 | 87.88 |
| V82 | D274N | GAT→AAC | 27.27 | 76.30 |
| V83 | D274N | GAT→AAC | 25.93 | 78.16 |
| *V84* | *V18* | *V18* | 25.62 | 99.17 |
| V85 | D274S | GAT→TCC | 25.56 | 77.97 |
| V86 | D274F | GAT→TTC | 23.97 | 66.72 |
| V87 | D274G | GAT→GGA | 23.11 | 59.72 |
| V91 | D274H | GAT→CAC | 34.13 | 60.54 |
| *V92* | *V18* | *V18* | 29.13 | 91.17 |
| V81 | D274M | GAT→ATG | 29.12 | 88.48 |
| V93 | D274E | GAT→GAG | 26.81 | 82.32 |
| V88 | D274G | GAT→GGA | 25.04 | 63.18 |
| V89 | D274G | GAT→GGC | 23.91 | 66.83 |

TABLE 13-continued

| CVS Variants | | | | |
|---|---|---|---|---|
| mutant ID | mutation(s) found vs. CVS V18 | Nucleotide changes vs. CVS V18 | Initial microculture (mg/L) | Valencene production % vs V18 |
| V90 | D274G | GAT→GGT | 23.09 | ND |
| V94 | F279S | TTT→TCT | 40.54 | 93.29 |
| V97 | F279I | TTT→ATT | 40.18 | 117.24 |
| *V98* | *V18* | *V18* | 38.86 | 123.14 |
| V99 | F279P<br>*L293L* | TTT→CCG<br>*TTG→TTA* | 36.78 | 88.83 |
| V101 | F279D | TTT→GAC | 36.74 | 106.98 |
| V102 | F279L | TTT→CTT | 35.81 | 114.77 |
| V105 | F279N<br>*G286G* | TTT→AAT<br>*GGT→GGC* | 35.74 | 100.60 |
| V107 | P281W<br>E350K | GCA→TGG<br>GAA→AAA | 35.39 | 98.90 |
| V108 | F279M | TTT→ATG | 33.30 | 99.71 |
| V109 | F279H | TTT→CAC | 33.26 | 94.56 |
| V110 | F279C | TTT→TGT | 33.23 | 89.25 |
| V95 | F279S | TTT→TCC | 33.17 | 95.03 |
| V112 | P281W | CCA→TGG | 33.12 | 112.41 |
| V113 | F279A | TTT→GCT | 32.36 | 114.04 |
| V103 | F279L | TTT→TTG | 32.03 | 105.28 |
| V106 | F279N | TTT→AAT | 32.02 | 114.22 |
| V114 | F279G | TTT→GGG | 32.00 | 87.99 |
| V100 | F279P<br>*L293L* | TTT→CCG<br>*TTG→TTA* | 31.92 | 80.85 |
| V115 | F279G | TTT→GGA | 31.61 | 137.85 |
| *V116* | *F279F* | *TTT→TTC* | 31.56 | 90.63 |
| V104 | F279L | TTT→TTG | 31.34 | 98.12 |
| V96 | F279S | TTT→TCC | 31.18 | 106.73 |
| V111 | F279C | TTT→TGT | 30.42 | 100.58 |
| V117 | F279W | TTT→TGG | 30.28 | ND |
| V118 | P281H | CCA→CAT | 53.53 | 106.87 |
| V119 | P281K | CCA→AAA | 36.16 | 154.73 |
| V121 | P281A | CCA→GCG | 34.19 | ND |
| V124 | P281S | CCA→TCA | 32.81 | 100.85 |
| V126 | P281W<br>Y283F | CCA→TGG<br>TAC→TTC | 32.06 | 89.54 |
| V127 | P281A<br>Q282P | CCA→GCC<br>CAA→CCA | 31.92 | 115.41 |
| *V128* | *P281P*<br>F316L | *CCA→CCC*<br>TTC→CTC | 31.53 | ND |
| V129 | E280L | GAA→CTG | 31.36 | 108.85 |
| V122 | P281A | CCA→GCA | 31.30 | 114.67 |

TABLE 13-continued

| CVS Variants | | | | |
|---|---|---|---|---|
| mutant ID | mutation(s) found vs. CVS V18 | Nucleotide changes vs. CVS V18 | Initial microculture (mg/L) | Valencene production % vs V18 |
| *V130* | *V18* | *V18* | 31.25 | 152.27 |
| V131 | P281L | CCA→CTG | 30.99 | 115.83 |
| V123 | P281A | CCA→GCA | 30.80 | 113.20 |
| V135 | P281Y | CCA→TAT | 30.78 | 105.12 |
| *V136* | *V18* | *V18* | 30.69 | 104.05 |
| V120 | P281K | CCA→AAG | 30.33 | 108.11 |
| V132 | P281L | CCA→CTT | 30.22 | ND |
| *V133* | *P281P* | *CCA→CCG* | 29.98 | ND |
| *V134* | *P281P* | *CCA→CCC* | 29.89 | 115.32 |
| V137 | P281L<br>Q282P | CCA→CTC<br>CAA→CCA | 29.52 | 118.62 |
| V125 | P281S<br>*Y262Y* | CCA→TCA<br>*TAT→TAC* | 29.29 | 128.96 |
| V138 | Q282S | CAA→TCA | 59.72 | 143.56 |
| V141 | Q282A | CAA→GCC | 48.71 | 108.55 |
| V143 | Q282I | CAA→ATC | 44.47 | 117.16 |
| V144 | Q282R | CAA→CGA | 36.84 | 118.06 |
| V146 | Q282Y | CAA→TAC | 36.78 | 133.03 |
| V142 | Q282A | CAA→GCA | 36.45 | 123.45 |
| V147 | Q282L | CAA→CTT | 36.44 | 119.24 |
| V140 | Q282S | CAA→TCT | 36.02 | 92.30 |
| V148 | Q282L | CAA→CTG | 35.99 | 114.81 |
| V145 | Q282R | CAA→CGT | 34.21 | 118.59 |
| V139 | Q282S | CAA→TCA | 34.00 | 105.80 |
| V149 | Q282G | CAA→GGG | 33.99 | 127.78 |
| V150 | Q282G<br>N324S | CAA→GGG<br>AAC→AGC | 33.79 | 121.49 |
| V151 | Q282A<br>N347S | CAA→GCG<br>AAC→AGC | 33.19 | 99.60 |
| V152 | Q282W | CAA→TGG | 33.18 | 102.63 |
| V153 | Q282P | CAA→CCG | 32.72 | ND |
| V154 | Q282P | CAA→CCT | 32.27 | ND |
| V155 | Q282E | CAA→GAG | 32.22 | ND |
| V156 | A284T<br>Y307H | GCT→ACG<br>TAC→CAC | 86.38 | 111.89 |
| V157 | A284G | GCT→GGC | 54.21 | 101.06 |
| V158 | A284P | GCT→CCA | 43.18 | 101.05 |
| *V177* | *A284A* | *GCT→GCG* | *40.44* | *119.95* |
| V159 | A284P | GCT→CCA | 40.41 | 105.71 |

TABLE 13-continued

| CVS Variants | | | | |
|---|---|---|---|---|
| mutant ID | mutation(s) found vs. CVS V18 | Nucleotide changes vs. CVS V18 | Initial microculture (mg/L) | Valencene production % vs V18 |
| V160 | A284G | GCT→GGA | 39.50 | 137.15 |
| V161 | A284V | GCT→GTC | 37.76 | 121.61 |
| V178 | Q282R | CAA→CGG | 36.94 | 105.85 |
| V162 | A284G<br>D301D/E<br>*A306A*<br>R358I/T/K/R<br>V378F/L/I/V<br>*G386G* | GCT→GGT<br>GAT→GAN<br>*GCT→GCG*<br>AGA→ANA<br>GTT→NTT<br>*GGT→GGN* | 36.79 | 103.46 |
| V163 | A284R | GCT→CGT | 35.98 | 99.88 |
| V165 | A284D | GCT→GAT | 35.58 | 132.28 |
| V167 | A284E | GCT→GAG | 35.55 | 92.50 |
| V168 | A284S<br>Y283N | GCT→TCC<br>TAC→AAC | 35.30 | 109.49 |
| V164 | A284R | GCT→AGG | 34.99 | 92.18 |
| V169 | A284H | GCT→AGG | 34.63 | 103.12 |
| V170 | A284K | GCT→AAG | 34.40 | 115.22 |
| V166 | A284D | GCT→GAT | 34.05 | 105.46 |
| V171 | A284I | GCT→ATC | 33.96 | 100.25 |
| V172 | A284W<br>L342X | GCT→TGG<br>TTG→NNG | 33.78 | 103.74 |
| V173 | A284T | GCT→ACC | 33.35 | 91.77 |
| *V175* | *A284A* | *GCT→GCA* | *32.98* | *99.42* |
| V174 | A284M<br>W323R | GCT→ATG<br>TGG→CGG | 32.81 | 94.09 |
| *V176* | *A284A* | *GCT→GCC* | *32.68* | *93.43* |

c. Increased Valencene Producing Isolates

Plasmid DNA was extracted from the transformants identified in the experiments above as producing greater than 110% of valencene relative to transformants containing the CVS V18 gene (i.e., a 10% increase versus CVS V18), and the nucleic acid sequences of the CVS genes were determined Table 14 below shows results of isolated mutants meeting this criterion. Table 14 sets forth the amino acid and nucleotide changes found by sequencing. Each of these mutations is present in addition to the 29 mutations present in CVS V18 (described in Example 3.B, above). The valencene production levels (measured from the cultures in shake flasks) relative to the levels produced by CVS V18 also are included in the table. In some instances, the nucleic acid mutation was silent such that the amino acid sequence of resulting valencene synthase was the same as that of CVS V18. Silent mutations are indicated in italic font. In other instances, mutations were observed in addition to the targeted mutation, likely due to errors introduced during the PCR amplification. Clone V40 contains the amino acid mutation A38V. Parental gene CVS V18 contains the mutation Q38A. Thus, the mutation in Clone V40 corresponds to Q38V for wildtype CVS.

TABLE 14

| CVS Variants | | | |
|---|---|---|---|
| mutant ID | mutation(s) found vs. CVS V18 | Nucleotide changes vs. CVS V18 | Valencene production % vs V18 |
| V20 | V320S;<br>E326K | GTT to TCG;<br>GAA to AAA | 133.3 |
| V21 | V320G;<br>R50G | GTT to GGT;<br>AGA to GGA | 126.8 |
| V22 | L315M | TTG to ATG | 126.5 |
| V24 | V320G | GTT to GGC | 123.1 |
| *V25* | *G286G* | *GGT to GGG* | *119.7* |
| *V26* | *L267L* | *TTG to CTT* | *119.5* |
| V27 | G357R | GGT to CGG | 117.9 |
| V28 | E367G | GAA to GGA | 116.9 |
| *V29* | *L315L* | *TTG to CTG* | *116.3* |

TABLE 14-continued

| CVS Variants | | | |
|---|---|---|---|
| mutant ID | mutation(s) found vs. CVS V18 | Nucleotide changes vs. CVS V18 | Valencene production % vs V18 |
| V30 | G357R | GGT to CGT | 115.9 |
| V31 | Q370D | CAA to GAC | 115.3 |
| V32 | I299Y | ATT to TAC | 114.8 |
| V33 | V320G | GTT to GGG | 114.7 |
| V34 | H360L | CAT to CTT | 114.4 |
| V35 | T317S | ACC to AGT | 114 |
| V36 | V320D | GTT to GAT | 113.7 |
| *V37* | *G276G* | *GGT to GGG* | *112.8* |
| *V38* | *S314S* | *TCT to TCG* | *112.6* |
| V40 | A38V [Q38V] | GCT to GTT | 112.6 |
| V41 | T409G; E495G | ACC to GGC; GAA to GGA | 112.1 |
| V39 | V320D | GTT to GAC | 111.9 |
| V23 | L315M | TTG to ATG | 111.7 |
| V42 | P281S; L337I | CCA to TCA; TTA to ATT | 111.7 |
| V43 | A375D | GCT to GAC | 111.6 |
| V44 | K336R | AAG to CGA | 110.9 |
| V45 | E311P | GAA to CCC | 110.9 |
| V46 | Q370H | CAA to CAC | 110.6 |
| V47 | T317S | ACC to TCA | 110.5 |
| V48 | L343V; H360A | TTG to GTG; CAT to GCC | 110.4 |
| V49 | Q282S | CAA to TCT | 110.4 |
| V50 | K371G | AAG to GGG | 110.4 |
| V51 | N347L | AAC to TTG | 110.3 |
| V52 | E311T | GAA to ACC | 110 |
| V53 | Q282L | CAA to CTG | 110 |
| V54 | S314T | TCT to ACG | 108.6 |
| V55 | Q370G | CAA to GGT | 108 |

TABLE 14-continued

| CVS Variants | | | |
|---|---|---|---|
| mutant ID | mutation(s) found vs. CVS V18 | Nucleotide changes vs. CVS V18 | Valencene production % vs V18 |
| V56 | L310H; V362A | TTG to CAC; GTA to GCA | 106.8 |
| V57 | L313C; F78L | TTG to TGC; TTT to CTT | 100.9 |

Example 4

Combination Mutants

In this example, CVS variants were generated containing a combination of mutations identified in Example 3. In addition, a variety of additional mutants were generated.

A. Combining Beneficial Mutations Identified by Saturation Mutagenesis

Beneficial mutations, identified as described in Example 3 above, were combined using overlapping PCR methods (see, Xiong et al., (2004) *Nucleic Acids Research* 32(12):e98) with CVS V19 as a template. Table 15 sets forth a series of 38 oligos that were generated containing mutations at the positions identified in Table 14 above. The oligos listed in Table 15 cover the region of the V19 gene beginning from the unique internal NdeI restriction site to the unique BglII restriction site. Each of the oligos belongs to one of eight overlapping sequence groups. The sequence groups are set forth in Table 16 below. Each oligo within a single sequence group provides either the wild type codon or mutant codon(s) of the indicated amino acids. Sequence overlaps between groups were designed to give melting temperatures of 40 to 50° C.

To obtain a complete, mutagenized DNA fragment of the NdeI and BglII region, one or more oligos from each of the eight sequence groups was combined in various PCR reactions. In each PCR reaction, the oligo(s) from groups one and eight were used at a total concentration of 30 pmol per 50 μL reaction. The oligos from groups 2 through 7 were used at a total concentration of 1.5 pmol per 50 μL reaction, per oligo group. The initial denaturation cycle was 2 minutes at 95° C. A "touchdown PCR" thermocycling protocol was used, wherein the initial annealing temperature of 46° C. was decreased by two degrees after each two cycles until a final annealing temperature of 38° C. was attained. A total of 30 PCR cycles were completed, including 22 cycles with an annealing temperature of 38° C. Each cycle consisted of a 30 second denaturation step, a 30 second annealing step, and a 2 minute extension step. The PCR protocol concluded with a 7 minute extension step. Completed PCR reaction products were gel purified from 1.2% agarose gels using either a Qiaquick gel extraction column (Qiagen) or a Freeze and Squeeze column (Bio-Rad). Cleaned PCR products were digested with restriction enzymes NdeI and BglII, and were ligated into the NdeI and BglII sites of YEp-CVS-UVA. Ligations were electroporated into *E. coli* DH10B cells as described in Example 3.C.2 above.

TABLE 15

| Oligos for overlapping PCR | | |
|---|---|---|
| Oligo | Sequence | SEQ ID NO |
| 21-73-1 | AAATTGCCATATGCTAGAGATAGATTGGTTGAATTGTACTTTTGGGATTTG | 299 |
| 21-73-2 | AAATTGCCATATGCTAGAGATAGACTTGTTGAATTGTACTTTTGGGATTTG | 300 |

TABLE 15-continued

Oligos for overlapping PCR

| Oligo | Sequence | SEQ ID NO |
|---|---|---|
| 21-73-3 | GATTTTTCTACCAAAAGCGTATTGTGRTTCAAAATAAGTMCCCAAATCCCAAAAGTAC | 301 |
| 21-73-4 | GATTTTTCTACCAAAAGCGTAAGATGRTTCAAAATAAGTMCCCAAATCCCAAAAGTAC | 302 |
| 21-73-5 | GATTTTTCTACCAAAAGCGTACAGTGRTTCAAAATAAGTMCCCAAATCCCAAAAGTAC | 303 |
| 21-73-6 | CTTTTGGTAGAAAAATCATGACTAAATTGAACTACATTTTGTCCATTATTGATGATACCTACGATG | 304 |
| 21-73-7 | CTTTTGGTAGAAAAATCATGACTAAATTGAACTACATTTTGTCCTACATTGATGATACCTACGATG | 305 |
| 21-73-8 | GAACAAAGACAATTCTTCCAAAGTACCGTAAGCATCGTAGGTATCATC | 306 |
| 21-73-9 | GGTGAACAAAGACAATTCTTCGTGAGTACCGTAAGCATCGTAGGTATCATC | 307 |
| 21-73-10 | GGTGAACAAAGACAATTCGGKCAAAGTACCGTAAGCATCGTAGGTATCATC | 308 |
| 21-73-11 | GGTGAACAAAGACAATTCGGKGTGAGTACCGTAAGCATCGTAGGTATCATC | 309 |
| 21-73-12 | TTCTTCCAAAGTACCGTAAGCATCGTAGGTATCATC | 310 |
| 21-73-13 | CAATTCTTCCAAAGTACCGTAAGCATCGTAGGTATCATC | 311 |
| 21-73-14 | RTCAGCTTCACTGAACAKCGWGCATTCGGKGTGAGTACCGTAAGCATCGTAGGTATCATC | 312 |
| 21-73-15 | VCCAGCTTCACTGAACAKCGWGCATTCGGKGTGAGTACCGTAAGCATCGTAGGTATCATC | 313 |
| 21-73-16 | GAATTGTCTTTGTTCACCGAAGCTGTTGCTCGTTGGAACATTGAAGC | 314 |
| 21-73-17 | GGTACTTTGGAAGAATTGWCGMTGTTCACCGAAGCTGTTGCTCGTTGGAACATTGAAGC | 315 |
| 21-73-18 | CTTACGGTACTTTGGAAGAATGCWCGMTGTTCACCGAAGCTGTTGCTCGTTGGAACATTGAAGC | 316 |
| 21-73-19 | CTTACGGTACTTTGGAAGAATGCWCGMTGTTCTCAGAAGCTGTTGCTCGTTGGAACATTGAAGC | 317 |
| 21-73-20 | CTTACGGTACTTTGGAAGAATGCWCGMTGTTCAGTGAAGCTGTTGCTCGTTGGAACATTGAAGC | 318 |
| 21-73-21 | GAAGAATTGTCTTTGTTCTCAGAAGCTGAYGCTCGTTGGAACATTGAAGC | 319 |
| 21-73-22 | GAAGAATTGTCTTTGTTCTCAGAAGCTGGBGCTCGTTGGAACATTGAAGC | 320 |
| 21-73-23 | GAAGAATTGTCTTTGTTCAGTGAAGCTGAYGCTCGTTGGAACATTGAAGC | 321 |
| 21-73-24 | GAAGAATTGTCTTTGTTCAGTGAAGCTGGBGCTCGTTGGAACATTGAAGC | 322 |
| 21-73-25 | GAAGAATTGTCTTTGTTCAGTGAAGCTGTTGCTCGTTGGAACATTGAAGC | 323 |
| 21-73-26 | GAAGAATTGTCTTTGTTCTCAGAAGCTGTTGCTCGTTGGAACATTGAAGC | 324 |
| 21-73-27 | GAAGAATTGTCTTTGTTCACCGAAGCTGAYGCTCGTTGGAACATTGAAGC | 325 |
| 21-73-28 | GAAGAATTGTCTTTGTTCACCGAAGCTGGBGCTCGTTGGAACATTGAAGC | 326 |
| 21-73-29 | CACMCCGAATGCWCGMTGTTCAGTGAAGCTGGBGCTCGTTGGAACATTGAAGC | 327 |
| 21-43-30 | CACMCCGAATGCWCGMTGTTCAGTGAAGCTGAYGCTCGTTGGAACATTGAAGC | 328 |
| 21-73-31 | TCTGTAGATTAACTTCATATAATCTGGCAACATGTCAACAGCTTCAATGTTCCAACGAGC | 329 |
| 21-73-32 | TCTGTAGATWAWTCGCATATAATCTGGCAACATGTCAACAGCTTCAATGTTCCAACGAGC | 330 |

TABLE 15-continued

| Oligos for overlapping PCR | | |
|---|---|---|
| Oligo | Sequence | SEQ ID NO |
| 21-73-33 | ATATGAAGTTAATCTACAGAACTTTGTTGGATACATTCAACGAAATAGAAG AGGATATGG | 331 |
| 21-73-34 | ATATGAAGWTWATCTACAGAACTTTGTTGGATACATTCTTGGAAATAGAAG AGGATATGG | 332 |
| 21-73-35 | ATATGCGAWTWATCTACAGAACTTTGTTGGATACATTCAACGAAATAGAAG AGGATATGG | 333 |
| 21-73-36 | ATATGCGAWTWATCTACAGAACTTTGTTGGATACATTCTTGGAAATAGAAG AGGATATGG | 334 |
| 21-73-37 | ACAATGAGATCTMCGTTGTTTAGCCATATCCTCTTCTATTTC | 335 |
| 21-73-38 | ACAATGAGATCTACCTTGTTTAGCCATATCCTCTTCTATTTC | 336 |

M is A or C; W is A or T; K is G or T; R is G or A; B is G or C or T; and Y is T or C.

TABLE 16

| Oligo Groups | | |
|---|---|---|
| Group Number | Oligos in group | Amino acids mutagenized |
| 1 | 21-73-1, 21-73-2 | 267 |
| 2 | 21-73-3, 21-73-4, 21-73-5 | 276, 281, 282 |
| 3 | 21-73-6, 21-73-7 | 299 |
| 4 | 21-73-8 through 21-73-15, inclusive | 310, 311, 313-315, 317, 320 |
| 5 | 21-73-16 through 21-73-30, inclusive | 310, 311, 313-315, 317, 320 |
| 6 | 21-73-31, 21-73-32 | 336 |
| 7 | 21-73-33 through 21-73-36, inclusive | 336, 336, 347 |
| 8 | 21-73-37, 21-73-38 | 357 |

Mutants were screened using the microvial method described in Example 3.C.2 above, and mutants with >110% valencene productivity of V19 were further screened in shake flask cultures. Various mutations were additionally screened using the ALX11-30 (ura3, trp1, erg9def25, HMG2cat/TRP1::rDNA, dpp1, sue) strain of *Saccharomyces cerevisiae* using the microvial method described in Example 3.C.2, above.

Table 17 below sets forth the identified mutants, including the nucleic acid and amino acid mutations, and the valencene production in shake flask cultures relative to the valencene production of transformants containing the CVS V19 gene. The mutations indicated in the table are in addition to the 29 mutations present in CVS V19, described in Example 3.B, above. In some instances, the nucleic acid mutation was silent such that the amino acid sequence of resulting valencene synthase was the same as that of CVS V19. Silent mutations are indicated in italic font. For example, in ALX7-95 cells, variant V58 produces 99.91% valencene as compared to the valencene production of CVS V19. Sequencing resulted in only partial sequence data for V180 and V181.

TABLE 17

| CVS Variants (mutations in addition to those in CVS V19) | | | | | | | |
|---|---|---|---|---|---|---|---|
| Mutant | Nucleotide changes vs. wildtype | Amino acid changes vs. wildtype | Nucleotide changes vs. CVS V19 | Amino acid changes vs. CVS V19 | SEQ ID NO nt | SEQ ID NO aa | Valencene production % vs. V19 (Shake Flask) |
| V58 | CCT→TCA<br>ATC→TAC<br>CTT→CAC<br>GAA→CCC | P281S<br>I299Y<br>L310H<br>E311P | CCA→TCA<br>ATT→TAC<br>TTG→CAC<br>GAA→CCC | P281S<br>I299Y<br>L310H<br>E311P | 185 | 50 | 99.91<br>(Alx7-95) |
| V60 | CCT→TCA<br>CAA→CTG<br>CTT→CAC | P281S<br>Q282L<br>L310H | *GGT→GGG*<br>CCA→TCA<br>CAA→CTG<br>TTG→CAC | *G276G*<br>P281S<br>Q282L<br>L310H | 186 | 51 | 108.53<br>(Alx7-95) |
| V59 | CCT→TCA<br>ATC→TAC<br>CTT→CAC<br>GAA→CCC | P281S<br>I299Y<br>L310H<br>E311P | CCA→TCA<br>ATT→TAC<br>TTG→CAC<br>GAA→CCC | P281S<br>I299Y<br>L310H<br>E311P | 185 | 50 | 96.17<br>(Alx7-95) |
| V61 | CCT→TCA<br>CAA→CTG<br>ATC→TAC | P281S<br>Q282L<br>I299Y | *GGT→GGG*<br>CCA→TCA<br>CAA→CTG | *G276G*<br>P281S<br>Q282L | 187 | 52 | 89.18<br>(Alx7-95) |

TABLE 17-continued

CVS Variants (mutations in addition to those in CVS V19)

| Mutant | Nucleotide changes vs. wildtype | Amino acid changes vs. wildtype | Nucleotide changes vs. CVS V19 | Amino acid changes vs. CVS V19 | SEQ ID NO nt | SEQ ID NO aa | Valencene production % vs. V19 (Shake Flask) |
|---|---|---|---|---|---|---|---|
| | GAA→CCC | E311P | ATT→TAC | I299Y | | | |
| | | | GAA→CCC | E311P | | | |
| V62 | CCT→TCA | P281S | *GGT→GGG* | *G276G* | 188 | 53 | 79.12 |
| | CTC→TGC | L313C | CCA→TCA | P281S | | | (Alx7-95) |
| | AGC→ACG | S314T | TTG→TGC | L313C | | | |
| | CTC→ATG | L315M | TCT→ACG | S314T | | | |
| | ACT→AGT | T317S | TTG→ATG | L315M | | | |
| | | | ACC→AGT | T317S | | | |
| V63 | CCT→TCA | P281S | CCA→TCA | P281S | 189 | 54 | 109.63 |
| | *AGC→TCG* | *S314S* | *TCT→TCG* | *S314S* | | | (Alx7-95) |
| | *CTC→CTG* | *L315L* | *TTG→CTG* | *L315L* | | | 77 and 97 |
| | AAA→CGA | K336R | AAG→CGA | K336R | | | (Alx11-30) |
| | AAT→TTG | N347L | AAC→TTG | N347L | | | |
| | GGA→CGT | G357R | GGT→CGT | G357R | | | |
| V64 | CTT→CAC | L310H | *GGT→GGG* | *G276G* | 190 | 55 | 75.46 |
| | GAA→ACC | E311T | TTG→CAC | L310H | | | (Alx7-95) |
| | CTC→TGC | L313C | GAA→ACC | E311T | | | |
| | AGC→ACG | S314T | TTG→TGC | L313C | | | |
| | CTC→ATG | L315M | TCT→ACG | S314T | | | |
| | ACT→AGT | T317S | TTG→ATG | L315M | | | |
| | GTT→GGC | V320G | ACC→AGT | T317S | | | |
| | | | GTT→GGC | V320G | | | |
| V66 | CCT→TCA | P281S | *GGT→GGG* | *G276G* | 192 | 56 | 86.56 |
| | ACT→AGT | T317S | CCA→TCA | P281S | | | (Alx7-95) |
| | AAA→CGA | K336R | ACC→AGT | T317S | | | |
| | TTG→ATT | L337I | AAG→CGA | K336R | | | |
| | AAT→TTG | N347L | TTA→ATT | L337I | | | |
| | GGA→CGG | G357R | AAC→TTG | N347L | | | |
| | | | GGT→CGG | G357R | | | |
| V67 | ACT→AGT | T317S | ACC→AGT | T317S | 193 | 57 | 101.46 |
| | AAA→CGA | K336R | AAG→CGA | K336R | | | (Alx7-95) |
| | TTG→ATT | L337I | TTA→ATT | L337I | | | |
| | GGA→CGG | G357R | GGT→CGG | G357R | | | |
| V68 | CCT→TCA | P281S | *GGT→GGG* | *G276G* | 194 | 58 | 99.32 |
| | ACT→AGT | T317S | CCA→TCA | P281S | | | (Alx7-95) |
| | AAA→CGA | K336R | ACC→AGT | T317S | | | |
| | AAT→TTG | N347L | AAG→CGA | K336R | | | |
| | GGA→CGG | G357R | AAC→TTG | N347L | | | |
| | | | GGT→CGG | G357R | | | |
| V69 | CCT→TCA | P281S | *GGT→GGG* | *G276G* | 195 | 59 | 98.89 |
| | ACT→AGT | T317S | CCA→TCA | P281S | | | (Alx7-95) |
| | GGA→CGG | G357R | ACC→AGT | T317S | | | |
| | | | GGT→CGG | G357R | | | |
| V65 | CTT→CAC | L310H | *GGT→GGG* | *G276G* | 191 | 55 | 96.91 |
| | GAA→ACC | E311T | TTG→CAC | L310H | | | (Alx7-95) |
| | CTC→TGC | L313C | GAA→ACC | E311T | | | |
| | AGC→ACG | S314T | TTG→TGC | L313C | | | |
| | CTC→ATG | L315M | TCT→ACG | S314T | | | |
| | ACT→AGT | T317S | TTG→ATG | L315M | | | |
| | GTT→GGG | V320G | ACC→AGT | T317S | | | |
| | | | GTT→GGG | V320G | | | |
| V70 | CCT→TCA | P281S | *GGT→GGG* | *G276G* | 196 | 60 | 85.16 |
| | CTT→CAC | L310H | CCA→TCA | P281S | | | (Alx7-95) |
| | GAA→ACC | E311T | TTG→CAC | L310H | | | |
| | CTC→TGC | L313C | GAA→ACC | E311T | | | |

TABLE 17-continued

CVS Variants (mutations in addition to those in CVS V19)

| Mutant | Nucleotide changes vs. wildtype | Amino acid changes vs. wildtype | Nucleotide changes vs. CVS V19 | Amino acid changes vs. CVS V19 | SEQ ID NO nt | SEQ ID NO aa | Valencene production % vs. V19 (Shake Flask) |
|---|---|---|---|---|---|---|---|
| | *AGC→TCG* | *S314S* | *TTG→TGC* | L313C | | | |
| | *CTC→CTG* | *L315L* | *TCT→TCG* | *S314S* | | | |
| | ACC→AGT | T317S | TTG→CTG | *L315L* | | | |
| | GTT→GGC | V320G | ACC→AGT | T317S | | | |
| | | | GTT→GGC | V320G | | | |
| V179 | *none* | *none* | *GGT→GGG* | *G276G* | 754 | 810 | 82 |
| | CCT→TCA | P281S | CCA→TCA | P281S | | | |
| | CAA→TCT | Q282S | CAA→TCT | Q282S | | | |
| | GAA→CCT | E311P | GAA→CCT | E311P | | | |
| V180 | *none* | *none* | *GGT→GGG* | *G276G* | 755 | 811 | 79 |
| | CCT→TCA | P281S | CCA→TCA | P281S | | | |
| | CAA→TCT | Q282S | CAA→TCT | Q282S | | | |
| | CTT→CAC | L310H | TTG→CAC | L310H | | | |
| | GAA→AAA | E318K | GAA→AAA | E318K | | | |
| V181 | *none* | *none* | *GGT→GGG* | *G276G* | 756 | 812 | 98 |
| | CCT→TCA | P281S | CCA→TCA | P281S | | | |
| | CAA→TCT | Q282S | CAA→TCT | Q282S | | | |
| | CTT→CAC | L310H | TTG→CAC | L310H | | | |
| V182 | *none* | *none* | *TTG→TTA* | *L293L* | 693 | 723 | 98.9 |
| | GAA→CCC | E311P | GAA→CCC | E311P | | | |
| V183 | ACT→AGT | T317S | ACC→AGT | T317S | 694 | 724 | 93 |
| | GTT→GGG | V320G | GTT→GGG | V320G | | | |
| V218 and | CTT→CAC | L310H | TTG→CAC | L310H | 716 | 746 | ND |
| V219 | GAA→CCC | E311P | GAA→CCC | E311P | | | |

B. Generation of Additional Valencene Synthase Mutants

Additional valencene synthase mutants, set forth in Table 19, were then produced using standard recombinant DNA and PCR methods. The mutations indicated in the table are in addition to the 29 mutations present in CVS V19, described in Example 3.B, above. The amino acid mutations identified in mutants V46, V43 and V41 (see Table 14 above) were combined using standard recombinant DNA and PCR methods to produce variants designated V184 and V185. To generate V184 and V185, primers 21-73.39 and 7-10.4 (see Table 18 below) were used in a single PCR reaction with plasmid DNA from mutant V41 as template.

Variants V73 and V74 were generated by recombination of mutations in V62 and V66. Variants V75 and V76 were generated by recombinations of mutations in V62 and V67. Variants V73, V74, V75 and V76 were all generated using the overlapping PCR technique as described in Example 3C, with the following exceptions. In the first stage, primers 7-10.3 and 21-71.42 were used in one reaction to amplify a portion of V62 and primers 21-71.41 and 7-10.4 were used in a section PCR to amplify a portion of either V66 or V67. Primers 7-10.3 and 7-10.4 then were used to generate a full-length gene from the two first stage products.

TABLE 18

Oligos for PCR

| Oligo | Sequence | SEQ ID NO |
|---|---|---|
| mutCVS2-7 | CTCGGTACCATTTAAAAAAATGNNNNNNNNNNNNNNNNNNAGACCAAC TGCTGATTTTC | 337 |
| 7-10.3 | CCAAGCTGAATTCGAGCTCG | 338 |
| 7-10.4 | ACTTGACCAAACCTCTGGCG | 339 |
| 21-73.39 | AGGTAGATCTCWTTGTGTAAGATACGCTAAAGAAGAAATTCAMAAGGT TATTGGTG | 897 |
| 21-71.41 | GCTCGTTGGAACATTGAAGCTGTTGACATG | 898 |

TABLE 18-continued

| Oligos for PCR | | |
|---|---|---|
| Oligo | Sequence | SEQ ID NO |
| 21-71.42 | CATGTCAACAGCTTCAATGTTCCAACGAGC | 899 |
| 21-108.1 | GTTAGAAGAATGATTNNNNNNNNNNNNNNNNNNNCCAATTCAAAAATTG | 900 |
| 21-108.2 | CAATTTTTGAATTGGNNNNNNNNNNNNNNNNNNNAATCATTCTTCTAAC | 901 |
| 21-140.1 | GAAGCAAGATACATTATGTCANNNNNNNNNNNNNNNNNNNNNNNNNNN NNNAACAAGACTTTGTTAAATTTCG | 902 |
| 21-140.2 | CGAAATTTAACAAAGTCTTGTTNNNNNNNNNNNNNNNNNNNNNNNNNN NNNNTGACATAATGTATCTTGCTTC | 903 |
| revAA2-7rnd | GAAAATCAGCAGTTGGTCTNNNNNNNNNNNNNNNNNNCATTTTTTTAA ATGGTACCGAG | 904 |
| 21-145.13 | CGCCCCGTCGCCGACTTCTCCCCATCTTTGTGGAAAAATC | 905 |
| 21-145.14 | GATTTTTCCACAAAGATGGGGAGAAGTCGGCGACGGGGCG | 906 |
| 21-145.15 | CGTCCTGTGGCAAACTTTCACCCATCTTTGTGGAAAAATC | 907 |
| 21-145.16 | GATTTTTCCACAAAGATGGGTGAAAGTTTGCCACAGGACG | 908 |
| 21-145.17 | CGCCCTGTTGCAGATTTTTCTCCATCTTTGTGGAAAAATC | 909 |
| 21-145.18 | GATTTTTCCACAAAGATGGAGAAAAATCTGCAACAGGGCG | 910 |
| 21-145.25 | GAAAAGTATGCTCAAGAGATTGAAGCTTTGAAGGAAGAAG | 911 |
| 21-145.26 | CTTCTTCCTTCAAAGCTTCAATCTCTTGAGCATACTTTTC | 912 |
| 21-145.27 | GCCTGCAAAGAGGAGCAGATTGAAGCTTTGAAGGAAGAAG | 913 |
| 21-145.28 | CTTCTTCCTTCAAAGCTTCAATCTGCTCCTCTTTGCAGGC | 914 |
| 21-445.29 | CATTTCAGATTGTTGAGACAACAAGGGTACACTATTTCATGTG | 915 |
| 21-145.30 | CACATGAAATAGTGTACCCTTGTTGTCTCAACAATCTGAAATG | 916 |
| 21-145.31 | CATTTCAGATTGTTGAGACAACACGGTTTCAACATCTCTC | 917 |
| 21-145.32 | GAGAGATGTTGAAACCGTGTTGTCTCAACAATCTGAAATG | 918 |
| 21-145.33 | CATTTCAGATTGTTGAGACAACATGGTTACAACGTCTCTCC | 919 |
| 21-145.34 | GGAGAGACGTTGTAACCATGTTGTCTCAACAATCTGAAATG | 920 |
| 21-145.35 | GACATCAGGGGCCTACTGAACTTGTATGAAGCTGCTTATATG | 921 |
| 21-145.36 | CATATAAGCAGCTTCATACAAGTTCAGTAGGCCCCTGATGTC | 922 |
| 21-145.37 | GATGTCTTAGGATTATTAAACTTGTATGAAGCTGCTTATATG | 923 |
| 21-145.38 | CATATAAGCAGCTTCATACAAGTTTAATAATCCTAAGACATC | 924 |
| 21-145.39 | GATGTAAGAGGCATGCTAGGCTTGTATGAAGCTGCTTATATG | 925 |
| 21-145.40 | CATATAAGCAGCTTCATACAAGCCTAGCATGCCTCTTACATC | 926 |

Mutants were screened in either ALX7-95 or ALX11-30 using the microvial method described in Example 3.C.2, above, and mutants with >110% valencene productivity of V19 (i.e., 10% greater valencene produced than wildtype) were further screened in shake flask cultures. Table 19 below sets forth the identified mutants, including the nucleic acid and amino acid mutations, and the valencene production in shake flask cultures relative to the valencene production of transformants containing the CVS V19 gene. The mutations indicated in the table are in addition to the 29 mutations present in CVS V19, described in Example 3.B, above. In some instances, the nucleic acid mutation was silent such that the amino acid sequence of resulting valencene synthase was the same as that of CVS V19. Silent mutations are indicated in italic font. The V75 variant was found to have an improvement in product distribution, resulting in a roughly 50% reduction in the production of side-product germacrene A, measured as β-elemene.

TABLE 19

| CVS Variants | | | | | | |
|---|---|---|---|---|---|---|
| Mutant | Nucleotide changes versus CVS V19 | Amino acid changes versus CVS V19 | SEQ ID NO nt | SEQ ID NO aa | Valencene as % of V19 in ALX7-95 | Valencene as % of V19 ALX11-30 |
| V184 | CAT→CTT<br>CAA→CAC<br>GCT→GAC<br>ACC→GGC<br>GAA→GGA | H360L<br>Q370H<br>A375D<br>T409G<br>E495G | 757 | 813 | 84 | ND |
| V185 | CAA→CAC<br>GCT→GAC<br>ACC→GGC<br>GAA→GGA | Q370H<br>A375D<br>T409G<br>E495G | 717 | 830 | 103.4 | ND |
| V72 | CAA→GAT<br>GCT→GAC<br>ACC→GGC<br>GAA→GGA | Q370D<br>A375D<br>T409G<br>E495G | 198 | 62 | 90 | ND |
| V71 | *GGT→GGG*<br>CCA→TCA<br>TTG→TGC<br>TCT→ACG<br>TTG→ATG<br>ACC→AGT<br>AAG→CGA<br>AAC→TTG<br>GGT→CGT | *G276G*<br>P281S<br>L313C<br>S314T<br>L315M<br>T317S<br>K336R<br>N347L<br>G357R | 197 | 61 | 123.52 | ND |
| V73 (same as V74) | *GGT→GGG*<br>CCA→TCA<br>TTG→TGC<br>TCT→ACG<br>TTG→ATG<br>ACC→AGT<br>AAG→CGA<br>TTA→ATA<br>AAC→TTG<br>GGT→CGT | *G276G*<br>P281S<br>L313C<br>S314T<br>L315M<br>T317S<br>K336R<br>L337I<br>N347L<br>G357R | 199 | 63 | 120.76 or 104.76 | ND |
| V75 (same as V76) | *GGT→GGG*<br>CCA→TCA<br>TTG→TGC<br>TCT→ACG<br>TTG→ATG<br>ACC→AGT<br>*GAC→GAT*<br>AAG→CGA<br>TTA→ATT<br>GGT→CGG | *G276G*<br>P281S<br>L313C<br>S314T<br>L315M<br>T317S<br>*D329D*<br>K336R<br>L337I<br>G357R | 130 | 5 | 100 or 124.39 | 100 |

ND: Not determined

C. Generation of Additional Valencene Synthase Mutants

Further additional valencene synthase mutants were produced using a variety of methods. The mutants were generated as described below in subsections a-e.

All of the generated mutants were screened in ALX7-95 using the microvial method described in Example 3.C.2, above, and mutants with >110% valencene productivity of CVS V19 (i.e., 10% increase in valencene versus CVS V19) were further screened in shake flask cultures. In some examples, mutants that had at least 90% of V19 titer, or mutants that had other desirable characteristics, such as an increase in enzyme specificity, were screened in shake flask cultures. The identified mutants were sequenced. Tables 20-24 below sets forth the identified mutants, including the nucleic acid and amino acid mutations, and the percent (%) valencene production in initial microcultures and shake flask cultures relative to the valencene production of transformants containing the CVS V19 gene.

Where indicated, the mutations indicated in the tables are in addition to the 29 mutations present in CVS V19, described in Example 3.B, above. In some instances, the nucleic acid mutation was silent such that the amino acid sequence of resulting valencene synthase was the same as that of CVS V19. In addition, the nucleic acid encoding the mutant CVS V19 (SEQ ID NO:129) is codon optimized for yeast. Thus, some of the silent mutations resulted in a codon that was the same as that for wildtype CVS. For example, in mutant V182, leucine 293 is encoded by the wildtype CVS codon TTA, whereas the parent CVS V19 codon was TTG. All silent mutations are indicated in italic font. Several mutants contain the mutation Q58K. Parental gene CVS V19 contains the mutation K58Q. Thus, compared to wildtype CVS, this mutation is silent, albeit with a change in the nucleic acid codon (AAG in wildtype CVS, AAA in the mutant CVS).

a. V186, V77, V187, V78, V188, V189, V190, V79, V191, V192, V193, V194 and V195

CVS variants V186, V77, V187, V78, V188, V189, V190, V79, V191, V192, V193, V194 and V195 were generated by a single PCR reaction from the CVS V19 gene using forward oligo mutCVS2-7 (SEQ ID NO:337) and reverse oligo 7-10.4 (SEQ ID NO:339). PCR cleanup, restriction digestion, ligations, transformations, and testing were performed as described in Section A above. The mutations were in addition to the 29 mutations present in CVS V19 (SEQ ID NO:4), described in Example 3.B, above. The variants, including amino acid and nucleotide changes versus both wildtype CVS and CVS V19, and valencene production % versus CVS V19 are set forth in Table 20 below.

TABLE 20

CVS Variants (mutations in addition to those in CVS V19)

| Mutant | Nucleotide change vs. wildtype | Amino acid changes vs. wildtype | Nucleotide change vs. CVS V19 | Amino acid changes vs. CVS V19 | SEQ ID NO nt | SEQ ID NO aa | Valencene production % vs. V19 (Shake Flask) |
|---|---|---|---|---|---|---|---|
| V186 | TCG→CCG | S2P | TCA→CCG | S2P | 758 | 814 | ND |
| | TCT→CGT | S3R | TCT→CGT | S3R | | | |
| | GGA→CGG | G4R | GGT→CGG | G4R | | | |
| | GAA→GAT | E5D | GAA→GAT | E5D | | | |
| | ACA→AGG | T6R | ACT→AGG | T6R | | | |
| | TTT→GCG | F7A | TTT→GCG | F7A | | | |
| V77 | TCG→CGG | S2R | TCA→CGG | S2R | 200 | 64 | 105 (Alx7-95) 96.28 (Alx11-30) |
| | TCT→GAC | S3D | TCT→GAC | S3D | | | |
| | GGA→AAG | G4K | GGT→AAG | G4K | | | |
| | GAA→GGT | E5G | GAA→GGT | E5G | | | |
| | *ACA→ACG* | *T6T* | *ACT→ACG* | *T6T* | | | |
| | TTT→TGT | F7C | TTT→TGT | F7C | | | |
| V187 | TCT→TTA | S3L | TCT→TTA | S3L | 759 | 815 | ND |
| | GGA→TCA | G4S | GGT→TCA | G4S | | | |
| | GAA→CAT | E5H | GAA→CAT | E5H | | | |
| | ACA→GAC | T6D | ACT→GAC | T6D | | | |
| | TTT→AGT | F7S | TTT→AGT | F7S | | | |
| V78 | TCG→GAG | S2E | TCA→GAG | S2E | 201 | 65 | 99.75 (Alx7-95) 107.9 (Alx11-30) |
| | TCT→GGA | S3G | TCT→GGA | S3G | | | |
| | GGA→AAT | G4N | GGT→AAT | G4N | | | |
| | GAA→AGT | E5S | GAA→AGT | E5S | | | |
| | ACA→GTC | T6V | ACT→GTC | T6V | | | |
| | TTT→CAA | F7Q | TTT→CAA | F7Q | | | |
| | TTT→CTC | F424L | TTC→CTC | F424L | | | |
| V188 | TCG→ACG | S2T | TCA→ACG | S2T | 760 | 816 | ND |
| | TCT→CGA | S3R | TCT→CGA | S3R | | | |
| | GAA→ATC | E5I | GAA→ATC | E5I | | | |
| | ACA→CTC | T6L | ACT→CTC | T6L | | | |
| | TTT→AAA | F7K | TTT→AAA | F7K | | | |
| V189 | TCG→TTA | S2L | TCA→TTA | S2L | 761 | 817 | ND |
| | TCT→GAT | S3D | TCT→GAT | S3D | | | |
| | GGA→AGT | G4S | GGT→AGT | G4S | | | |
| | GAA→ATC | E5I | GAA→ATC | E5I | | | |
| | ACA→GCA | T6A | ACT→GCA | T6A | | | |
| | TTT→GGG | F7G | TTT→GGG | F7G | | | |
| V190 | TCG→CAT | S2H | TCA→CAT | S2H | 762 | 818 | ND |
| | TCT→GAG | S3E | TCT→GAG | S3E | | | |
| | GGA→CCC | G4P | GGT→CCC | G4P | | | |
| | GAA→TCT | E5S | GAA→TCT | E5S | | | |
| | ACA→GAG | T6E | ACT→GAG | T6E | | | |
| | TTT→ACT | F7T | TTT→ACT | F7T | | | |
| V79 | TCG→AAG | S2K | TCA→AAG | S2K | 202 | 66 | 103 (Alx7-95) |
| | TCT→CGC | S3R | TCT→CGC | S3R | | | |
| | GGA→GTA | G4V | GGT→GTA | G4V | | | |
| | GAA→GGG | E5G | GAA→GGG | E5G | | | |
| | ACA→AGG | T6R | ACT→AGG | T6R | | | |
| | TTT→GCG | F7A | TTT→GCG | F7A | | | |
| V191 | TCG→CTA | S2L | TCA→CTA | S2L | 763 | 819 | ND |
| | TCT→GGC | S3G | TCT→GGC | S3G | | | |
| | GGA→GTT | G4V | GGT→GTT | G4V | | | |
| | GAA→TCT | E5S | GAA→TCT | E5S | | | |
| | ACA→GAA | T6E | ACT→GAA | T6E | | | |
| | TTT→CAA | F7Q | TTT→CAA | F7Q | | | |

TABLE 20-continued

| CVS Variants (mutations in addition to those in CVS V19) | | | | | | | |
|---|---|---|---|---|---|---|---|
| Mutant | Nucleotide change vs. wildtype | Amino acid changes vs. wildtype | Nucleotide change vs. CVS V19 | Amino acid changes vs. CVS V19 | SEQ ID NO nt | SEQ ID NO aa | Valencene production % vs. V19 (Shake Flask) |
| V192 | TCG→CGG | S2R | TCA→CGG | S2R | 764 | 820 | ND |
| | TCT→GTG | S3V | TCT→GTG | S3V | | | |
| | GGA→GCG | G4A | GGT→GCG | G4A | | | |
| | GAA→CCT | E5P | GAA→CCT | E5P | | | |
| | ACA→AAA | T6K | ACT→AAA | T6K | | | |
| V193 | TCG→AGA | S2R | TCA→AGA | S2R | 765 | 821 | ND |
| | TCT→GCT | S3A | TCT→GCT | S3A | | | |
| | GGA→GAA | G4E | GGT→GAA | G4E | | | |
| | GAA→CTG | E5L | GAA→CTG | E5L | | | |
| | ACA→AGC | T6S | ACT→AGC | T6S | | | |
| | TTT→CTT | F7L | TTT→CTT | F7L | | | |
| V194 | TCG→CAG | S2Q | TCA→CAG | S2Q | 695 | 725 | 95.91 |
| | *TCT→AGC* | *S3S* | *TCT→AGC* | *S3S* | | | |
| | GGA→ATT | G4I | GGT→ATT | G4I | | | |
| | GAA→ACG | E5T | GAA→ACG | E5T | | | |
| | ACA→GAC | T6D | ACT→GAC | T6D | | | |
| | TTT→AAG | F7K | TTT→AAG | F7K | | | |
| V195 | TCG→AGG | S2R | TCA→AGG | S2R | 766 | 822 | ND |
| | TCT→GTG | S3V | TCT→GTG | S3V | | | |
| | GGA→ATT | G4I | GGT→ATT | G4I | | | |
| | GAA→GAT | E5D | GAA→GAT | E5D | | | |
| | ACA→GGC | T6G | ACT→GGC | T6G | | | |
| | TTT→GGG | F7G | TTT→GGG | F7G | | | |

b. V196, V197, V198, V200, V201, V202, V203, V204, V205, V206, V207, V212, V213, V214, V215, V216 and V217

CVS variants V196, V197, V198, V200, V201, V202, V203, V204, V205, V206, V207, V212, V213, V214, V215, V216 and V217 contain mutations at various amino acids, including L106, R132, M153, H159, Q188, I189, P202, I213, H219, I397 and K474. These mutants were generated by saturation mutagenesis of single amino acid positions of the amino terminal non-catalytic domain of the CVS V19 gene as described in Example 3C.1, with the exception that outer primers 7-10.3 and 7-10.4 (see Table 18), were used in place of primers 11-157.7 and 11-157.8, respectively. PCR cleanup, restriction digestion, ligations, transformations, and testing were performed as described in Section A above. The variants, including amino acid and nucleotide changes versus both wildtype CVS and CVS V19, and valencene production % versus CVS V19 are set forth in Table 21 below. The mutations were in addition to the 29 mutations present in CVS V19 (SEQ ID NO:4), described in Example 3.B, above, with the exception of variant V202. As indicated in Table 21 below, wildtype CVS contains a histidine at residue 219 and CVS V19 contains an aspartic acid at residue 219, whereas V202 contains an alanine at residue 219.

TABLE 21

| CVS Variants (mutations in addition to those in CVS V19) | | | | | | | |
|---|---|---|---|---|---|---|---|
| Mutant | Nucleotide change vs. wildtype | Amino acid changes vs. wildtype | Nucleotide change vs. CVS V19 | Amino acid changes vs. CVS V19 | SEQ ID NO nt | SEQ ID NO aa | Valencene production % vs. V19 (Shake Flask) |
| V196 | CTT→GCC | L106A | TTG→GCC | L106A | 696 | 726 | 110.59 |
| | *AGT→TCC* | *S146S* | *TCT→TCC* | *S146S* | | | |
| V197 | CTT→TCG | L106S | TTG→TCG | L106S | 697 | 727 | 109.57 |
| V198 | CTT→AAG | L106K | TTG→AAG | L106K | 698 | 728 | 116.26 |
| V200 | ATG→AAT | M153N | ATG→AAT | M153N | 699 | 729 | 128.6 |
| | *none* | *none* | *TTA→TTG* | *L337L* | | | |
| | AAG→ACG | K474T | AAG→ACG | K474T | | | |
| V201 | ATC→TCG | I213S | ATT→TCG | I213S | 768 | 824 | ND |
| V202 | CAT→GCC | H219A | GAT→GCC | D219A | 700 | 730 | 96.7 |

TABLE 21-continued

CVS Variants (mutations in addition to those in CVS V19)

| Mutant | Nucleotide change vs. wildtype | Amino acid changes vs. wildtype | Nucleotide change vs. CVS V19 | Amino acid changes vs. CVS V19 | SEQ ID NO nt | SEQ ID NO aa | Valencene production % vs. V19 (Shake Flask) |
|---|---|---|---|---|---|---|---|
| V203 | CAG→CGA | Q188R | CAA→CGA | Q188R | 769 | 825 | 115.36 |
| | ATA→GTT | I189V | ATT→GTT | I189V | | | |
| | CCA→TCA | P202S | CCA→TCA | P202S | | | |
| | *GGA→GGC* | *G374G* | *GGT→GGC* | *G374G* | | | |
| | *GAA→GAG* | *E475E* | *GAA→GAG* | *E475E* | | | |
| V204 | ATG→AAT | M153N | ATG→AAT | M153N | 770 | 826 | 112.74 |
| | AAG→ACG | K474T | AAG→ACG | K474T | | | |
| V205 | CAT→CGC | H159R | CAT→CGC | H159R | 771 | 827 | 120.57 |
| V206 | CAT→AAA | H159K | CAT→AAA | H159K | 772 | 828 | 116.01 |
| V207 | ATA→CCC | I189P | ATT→CCC | I189P | 773 | 829 | 115.81 |
| V212 | AGA→GGA | R132G | AGA→GGA | R132G | 707 | 737 | 101.86 |
| V213 | CAT→CAA | H159Q | CAT→CAA | H159Q | 708 | 738 | 125.17 |
| | *GAA→GAG* | *E318E* | *GAA→GAG* | *E318E* | | | |
| | *none* | *none* | *GAA→GAG* | *E326E* | | | |
| | *ATT→ATC* | *I391I* | *ATT→ATC* | *I391I* | | | |
| V214 | ATG→GGG | M153G | ATG→GGG | M153G | 709 | 739 | 121.35 |
| V215 | ATT→GTT | I397V | ATT→GTT | I397V | 710 | 740 | 125.90 |
| | *none* | *none* | *CAT→CAC* | *H77H* | | | |
| V216 | *ATT→ATC* | *I189I* | *ATT→ATC* | *I189I* | 711 | 741 | 123.20 |
| | *AGA→AGG* | *R203R* | *AGA→AGG* | *R203R* | | | |
| V217 | ATA→GCG | I189A | ATT→GCG | I189A | 712 | 742 | 120.30 |
| | *AGA→AGG* | *R203R* | *AGA→AGG* | *R203R* | | | |

c. V199, V208, V209, V210 and V211

CVS variants V199, V208, V209, V210 and V211 contain mutations at amino acids 53 through 58, and were generated by a single PCR reaction from the CVS V19 gene using forward oligo 21-108-1 (SEQ ID NO:340) and reverse oligo 21-108-2 (SEQ ID NO:341) (see Table 18). The variants, including amino acid and nucleotide changes versus both wildtype CVS and CVS V19, and valencene production % versus CVS V19 are set forth in Table 22 below. V209 additionally contains a mutation at L106, introduced during PCR amplification.

TABLE 22

CVS Variants

| Mutant | Nucleotide change vs. wildtype | Amino acid changes vs. wildtype | Nucleotide change vs. CVS V19 | Amino acid changes vs. CVS V19 | SEQ ID NO nt | SEQ ID NO aa | Valencene production % vs. V19 (Shake Flask) |
|---|---|---|---|---|---|---|---|
| V199 | AAA→CAA | K24Q | ACT→CTA | T53L | 767 | 823 | 105.81 |
| | CAA→AAT | Q38N | GAT→GCC | D54A | | | |
| | ACA→CTA | T53L | GCA→CCA | A55P | | | |
| | GAT→GCC | D54A | GAA→CCG | E56P | | | |
| | GCT→CCA | A55P | GAT→ CCC | D57P | | | |
| | GAA→CCG | E56P | CAA→CGC | Q58R | | | |
| | GAT→ CCC | D57P | | | | | |
| | AAG→CGC | K58R | | | | | |
| | GTT→ATT | V60I | | | | | |
| | AAA→CAA | K88Q | | | | | |
| | TAT→CAT | Y93H | | | | | |
| | AAT→GAT | N97D | | | | | |
| | AGA→AAA | R98K | | | | | |
| | AAG→CAA | K125Q | | | | | |
| | AAG→CAA | K173Q | | | | | |

TABLE 22-continued

| CVS Variants | | | | | | | |
|---|---|---|---|---|---|---|---|
| Mutant | Nucleotide change vs. wildtype | Amino acid changes vs. wildtype | Nucleotide change vs. CVS V19 | Amino acid changes vs. CVS V19 | SEQ ID NO nt | SEQ ID NO aa | Valencene production % vs. V19 (Shake Flask) |
| | AAG→AGA | K184R | | | | | |
| | TTT→ATT | F209I | | | | | |
| | ATG→AGA | M212R | | | | | |
| | AAT→GAT | N214D | | | | | |
| | CAT→GAT | H219D | | | | | |
| | TAC→GTT | Y221V | | | | | |
| | GAG→GAT | E238D | | | | | |
| | AAA→CAA | K252Q | | | | | |
| | CAA→AAA | Q292K | | | | | |
| | CAA→GCT | Q321A | | | | | |
| | GAA→GAT | E333D | | | | | |
| | GCT→ACA | A345T | | | | | |
| | AAT→ATT | N369I | | | | | |
| | TCT→TAC | S377Y | | | | | |
| | ACA→AGA | T405R | | | | | |
| | AAT→GGT | N429G | | | | | |
| | GCA→TCT | A436S | | | | | |
| | ACC→CCA | T501P | | | | | |
| | GAT→GAA | D536E | | | | | |
| V208 | AAA→CAA | K24Q | ACT→CTC | T53L | 701 | 731 | 109.2 |
| | CAA→AAT | Q38N | GAT→CCT | D54P | | | |
| | ACA→CTC | T53L | GCA→CGC | A55R | | | |
| | GAT→CCT | D54P | GAA→TTC | E56F | | | |
| | GCT→CGC | A55R | GAT→TCG | D57S | | | |
| | GAA→TTC | E56F | *none* | *none* | | | |
| | GAT→TCG | D57S | | | | | |
| | AAG→CAA | K58Q | | | | | |
| | GTT→ATT | V60I | | | | | |
| | AAA→CAA | K88Q | | | | | |
| | TAT→CAT | Y93H | | | | | |
| | AAT→GAT | N97D | | | | | |
| | AGA→AAA | R98K | | | | | |
| | AAG→CAA | K125Q | | | | | |
| | AAG→CAA | K173Q | | | | | |
| | AAG→AGA | K184R | | | | | |
| | TTT→ATT | F209I | | | | | |
| | ATG→AGA | M212R | | | | | |
| | AAT→GAT | N214D | | | | | |
| | CAT→GAT | H219D | | | | | |
| | TAC→GTT | Y221V | | | | | |
| | GAG→GAT | E238D | | | | | |
| | AAA→CAA | K252Q | | | | | |
| | CAA→AAA | Q292K | | | | | |
| | CAA→GCT | Q321A | | | | | |
| | GAA→GAT | E333D | | | | | |
| | GCT→ACA | A345T | | | | | |
| | AAT→ATT | N369I | | | | | |
| | TCT→TAC | S377Y | | | | | |
| | ACA→AGA | T405R | | | | | |
| | AAT→GGT | N429G | | | | | |
| | GCA→TCT | A436S | | | | | |
| | ACC→CCA | T501P | | | | | |
| | GAT→GAA | D536E | | | | | |
| V209 | AAA→CAA | K24Q | *ACT→ACG* | *T53T* | 704 | 734 | 104.53 |
| | CAA→AAT | Q38N | GAT→GCC | D54A | | | |
| | *ACA→ACG* | *T53T* | GCA→GTT | A55V | | | |
| | GAT→GCC | D54A | GAA→GCC | E56A | | | |
| | GCT→GTT | A55V | GAT→CAG | D57Q | | | |
| | GAA→GCC | E56A | CAA→CCC | Q58P | | | |
| | GAT→CAG | D57Q | TTG→TTC | L106F | | | |
| | AAG→CCC | K58P | | | | | |
| | GTT→ATT | V60I | | | | | |
| | AAA→CAA | K88Q | | | | | |
| | TAT→CAT | Y93H | | | | | |
| | AAT→GAT | N97D | | | | | |
| | AGA→AAA | R98K | | | | | |
| | CTT→TTC | L106F | | | | | |
| | AAG→CAA | K125Q | | | | | |
| | AAG→CAA | K173Q | | | | | |

TABLE 22-continued

CVS Variants

| Mutant | Nucleotide change vs. wildtype | Amino acid changes vs. wildtype | Nucleotide change vs. CVS V19 | Amino acid changes vs. CVS V19 | SEQ ID NO nt | SEQ ID NO aa | Valencene production % vs. V19 (Shake Flask) |
|---|---|---|---|---|---|---|---|
| | AAG→AGA | K184R | | | | | |
| | TTT→ATT | F209I | | | | | |
| | ATG→AGA | M212R | | | | | |
| | AAT→GAT | N214D | | | | | |
| | CAT→GAT | H219D | | | | | |
| | TAC→GTT | Y221V | | | | | |
| | GAG→GAT | E238D | | | | | |
| | AAA→CAA | K252Q | | | | | |
| | CAA→AAA | Q292K | | | | | |
| | CAA→GCT | Q321A | | | | | |
| | GAA→GAT | E333D | | | | | |
| | GCT→ACA | A345T | | | | | |
| | AAT→ATT | N369I | | | | | |
| | TCT→TAC | S377Y | | | | | |
| | ACA→AGA | T405R | | | | | |
| | AAT→GGT | N429G | | | | | |
| | GCA→TCT | A436S | | | | | |
| | ACC→CCA | T501P | | | | | |
| | GAT→GAA | D536E | | | | | |
| V210 | AAA→CAA | K24Q | *TTG→TTA* | *L44L* | 705 | 735 | 102.97 |
| | CAA→AAT | Q38N | ACT→CGA | T53R | | | |
| | *CTG→TTA* | *L44L* | GAT→GCA | D54A | | | |
| | ACA→CGA | T53R | GCA→CAA | A55Q | | | |
| | GAT→GCA | D54A | GAA→ACC | E56T | | | |
| | GCT→CAA | A55Q | GAT→GCC | D57A | | | |
| | GAA→ACC | E56T | CAA→CGG | Q58R | | | |
| | GAT→GCC | D57A | *ATT→ATC* | *I92I* | | | |
| | AAG→CGG | K58R | *TAT→TAC* | *Y532Y* | | | |
| | GTT→ATT | V60I | | | | | |
| | AAA→CAA | K88Q | | | | | |
| | TAT→CAT | Y93H | | | | | |
| | AAT→GAT | N97D | | | | | |
| | AGA→AAA | R98K | | | | | |
| | AAG→CAA | K125Q | | | | | |
| | AAG→CAA | K173Q | | | | | |
| | AAG→AGA | K184R | | | | | |
| | TTT→ATT | F209I | | | | | |
| | ATG→AGA | M212R | | | | | |
| | AAT→GAT | N214D | | | | | |
| | CAT→GAT | H219D | | | | | |
| | TAC→GTT | Y221V | | | | | |
| | GAG→GAT | E238D | | | | | |
| | AAA→CAA | K252Q | | | | | |
| | CAA→AAA | Q292K | | | | | |
| | CAA→GCT | Q321A | | | | | |
| | GAA→GAT | E333D | | | | | |
| | GCT→ACA | A345T | | | | | |
| | AAT→ATT | N369I | | | | | |
| | TCT→TAC | S377Y | | | | | |
| | ACA→AGA | T405R | | | | | |
| | AAT→GGT | N429G | | | | | |
| | GCA→TCT | A436S | | | | | |
| | ACC→CCA | T501P | | | | | |
| | GAT→GAA | D536E | | | | | |
| V211 | AAA→CAA | K24Q | ACT→CGG | T53R | 706 | 736 | 112.23 |
| | CAA→AAT | Q38N | GAT→TGC | D54C | | | |
| | ACA→CGG | T53R | GCA→GTT | A55V | | | |
| | GAT→TGC | D54C | GAA→CAG | E56Q | | | |
| | GCT→GTT | A55V | GAT→CCA | D57P | | | |
| | GAA→CAG | E56Q | CAA→GAG | Q58E | | | |
| | GAT→CCA | D57P | *GCT→GCC* | *A263A* | | | |
| | AAG→GAG | K58E | | | | | |
| | GTT→ATT | V60I | | | | | |
| | AAA→CAA | K88Q | | | | | |
| | TAT→CAT | Y93H | | | | | |
| | AAT→GAT | N97D | | | | | |
| | AGA→AAA | R98K | | | | | |
| | AAG→CAA | K125Q | | | | | |
| | AAG→CAA | K173Q | | | | | |

TABLE 22-continued

| CVS Variants | | | | | | | |
|---|---|---|---|---|---|---|---|
| Mutant | Nucleotide change vs. wildtype | Amino acid changes vs. wildtype | Nucleotide change vs. CVS V19 | Amino acid changes vs. CVS V19 | SEQ ID NO nt | SEQ ID NO aa | Valencene production % vs. V19 (Shake Flask) |
| | AAG→AGA | K184R | | | | | |
| | TTT→ATT | F209I | | | | | |
| | ATG→AGA | M212R | | | | | |
| | AAT→GAT | N214D | | | | | |
| | CAT→GAT | H219D | | | | | |
| | TAC→GTT | Y221V | | | | | |
| | GAG→GAT | E238D | | | | | |
| | AAA→CAA | K252Q | | | | | |
| | *GCA→GCC* | *A263A* | | | | | |
| | CAA→AAA | Q292K | | | | | |
| | CAA→GCT | Q321A | | | | | |
| | GAA→GAT | E333D | | | | | |
| | GCT→ACA | A345T | | | | | |
| | AAT→ATT | N369I | | | | | |
| | TCT→TAC | S377Y | | | | | |
| | ACA→AGA | T405R | | | | | |
| | AAT→GGT | N429G | | | | | |
| | GCA→TCT | A436S | | | | | |
| | ACC→CCA | T501P | | | | | |
| | GAT→GAA | D536E | | | | | |

d. V220, V221, V222, V223, V224, V225 and V226

CVS variants V220, V221, V222, V223, V224 and V225 were generated by a two-stage overlapping PCR protocol similar to that in Example 4.C.a., using the V75 gene as a template. V226 used the V19 gene as template as a comparison to variants produced using V75 as template. First stage PCR reactions used either mutagenic primer 21-140.1 with outer primer 7-10.4, or mutagenic primer 21-140.2 with outer primer 7-10.3 (see Table 18). These mutagenic primers simultaneously randomize the codons for amino acids 212-221 of CVS V19, or its derivatives, including V75. Second stage PCR reactions used primers 7-10.3 and 7-10.4. PCR cleanup, restriction digestion, ligations, transformations, and testing were performed as described in Section A above. The variants, including amino acid and nucleotide changes versus both wildtype CVS and CVS V19, and valencene production % versus CVS V19 are set forth in Table 23 below. V223 does not contain the P281S mutation found in V75 and, V224 has an additional mutation of A319T. These mutations were introduced during PCR amplification.

TABLE 23

| CVS Variants | | | | | | | |
|---|---|---|---|---|---|---|---|
| Mutant | Nucleotide changes vs. wildtype | Amino acid changes vs. wildtype | Nucleotide changes vs. CVS V19 | Amino acid changes vs. CVS V19 | SEQ ID NO nt | SEQ ID NO aa | Valencene production % vs. V19 (Shake Flask) |
| V220 | AAA→CAA | K24Q | *TTG→CTG* | *L193L* | 718 | 747 | 76 |
| | CAA→AAT | Q38N | AGA→AAT | R212N | | | (665 mg/L) |
| | AAG→CAA | K58Q | ATT→TAT | I213Y | | | |
| | GTT→ATT | V60I | GAT→CTG | D214L | | | |
| | AAA→CAA | K88Q | TCT→AGG | S215R | | | |
| | TAT→CAT | Y93H | ACT→CGT | T216R | | | |
| | AAT→GAT | N97D | TCT→ATT | S217I | | | |
| | AGA→AAA | R98K | GAT→CCC | D218P | | | |
| | AAG→CAA | K125Q | GAT→GCA | D219A | | | |
| | AAG→CAA | K173Q | TTG→GAT | L220D | | | |
| | AAG→AGA | K184R | GTT→TCT | V221S | | | |
| | *TTA→CTG* | *L193L* | *GGT→GGG* | *G276G* | | | |
| | TTT→ATT | F209I | CCA→TCA | P281S | | | |
| | ATG→AAT | M212N | TTG→TGC | L313C | | | |
| | ATC→TAT | I213Y | TCT→ACG | S314T | | | |
| | AAT→CTG | N214L | TTG→ATG | L315M | | | |
| | TCA→AGG | S215R | ACC→AGT | T317S | | | |
| | ACA→CGT | T216R | *GAC→GAT* | *D329D* | | | |
| | AGT→ATT | S217I | AAG→CGA | K336R | | | |
| | GAT→CCC | D218P | TTA→ATT | L337I | | | |
| | CAT→GCA | H219A | GGT→CGG | G357R | | | |
| | TTA→GAT | L220D | | | | | |
| | TAC→TCT | Y221S | | | | | |

TABLE 23-continued

| CVS Variants | | | | | | | |
|---|---|---|---|---|---|---|---|
| Mutant | Nucleotide changes vs. wildtype | Amino acid changes vs. wildtype | Nucleotide changes vs. CVS V19 | Amino acid changes vs. CVS V19 | SEQ ID NO nt | SEQ ID NO aa | Valencene production % vs. V19 (Shake Flask) |
| | GAG→GAT | E238D | | | | | |
| | AAA→CAA | K252Q | | | | | |
| | CCT→TCA | P281S | | | | | |
| | CAA→AAA | Q292K | | | | | |
| | CTC→TGC | L313C | | | | | |
| | AGC→ACG | S314T | | | | | |
| | CTC→ATG | L315M | | | | | |
| | ACT→AGT | T317S | | | | | |
| | CAA→GCT | Q321A | | | | | |
| | GAA→GAT | E333D | | | | | |
| | AAA→CGA | K336R | | | | | |
| | TTG→ATT | L337I | | | | | |
| | GCT→ACA | A345T | | | | | |
| | GGA→CGG | G357R | | | | | |
| | AAT→ATT | N369I | | | | | |
| | TCT→TAC | S377Y | | | | | |
| | ACA→AGA | T405R | | | | | |
| | AAT→GGT | N429G | | | | | |
| | GCA→TCT | A436S | | | | | |
| | ACC→CCA | T501P | | | | | |
| | GAT→GAA | D536E | | | | | |
| V221 | AAA→CAA | K24Q | CAA→CGA | Q113R | 719 | 748 | 75 |
| | CAA→AAT | Q38N | AGA→GAC | R212D | | | (656 mg/L) |
| | AAG→CAA | K58Q | ATT→TAT | I213Y | | | |
| | GTT→ATT | V60I | GAT→GAG | D214E | | | |
| | AAA→CAA | K88Q | TCT→CAC | S215H | | | |
| | TAT→CAT | Y93H | ACT→CAA | T216Q | | | |
| | AAT→GAT | N97D | GAT→ATT | D218I | | | |
| | AGA→AAA | R98K | GAT→TTA | D219L | | | |
| | CAG→CGA | Q113R | TTG→GTT | L220V | | | |
| | AAG→CAA | K125Q | GTT→CAA | V221Q | | | |
| | AAG→CAA | K173Q | *GGT→GGG* | *G276G* | | | |
| | AAG→AGA | K184R | CCA→TCA | P281S | | | |
| | TTT→ATT | F209I | TTG→TGC | L313C | | | |
| | ATG→GAC | M212D | TCT→ACG | S314T | | | |
| | ATC→TAT | I213Y | TTG→ATG | L315M | | | |
| | AAT→GAG | N214E | ACC→AGT | T317S | | | |
| | TCA→CAC | S215H | *GAC→GAT* | *D329D* | | | |
| | ACA→CAA | T216Q | AAG→CGA | K336R | | | |
| | *AGT→TCT* | *S217S* | TTA→ATT | L337I | | | |
| | GAT→ATT | D218I | GGT→CGG | G357R | | | |
| | CAT→TTA | H219L | | | | | |
| | TTA→GTT | L220V | | | | | |
| | TAC→CAA | Y221Q | | | | | |
| | GAG→GAT | E238D | | | | | |
| | AAA→CAA | K252Q | | | | | |
| | CCT→TCA | P281S | | | | | |
| | CAA→AAA | Q292K | | | | | |
| | CTC→TGC | L313C | | | | | |
| | AGC→ACG | S314T | | | | | |
| | CTC→ATG | L315M | | | | | |
| | ACT→AGT | T317S | | | | | |
| | CAA→GCT | Q321A | | | | | |
| | GAA→GAT | E333D | | | | | |
| | AAA→CGA | K336R | | | | | |
| | TTG→ATT | L337I | | | | | |
| | GCT→ACA | A345T | | | | | |
| | GGA→CGG | G357R | | | | | |
| | AAT→ATT | N369I | | | | | |
| | TCT→TAC | S377Y | | | | | |
| | ACA→AGA | T405R | | | | | |
| | AAT→GGT | N429G | | | | | |
| | GCA→TCT | A436S | | | | | |
| | ACC→CCA | T501P | | | | | |
| | GAT→GAA | D536E | | | | | |
| V222 | AAA→CAA | K24Q | AGA→TCC | R212S | 774 | 831 | 80 |
| | CAA→AAT | Q38N | ATT→CTG | I213L | | | (703 mg/L) |
| | AAG→CAA | K58Q | GAT→GAA | D214E | | | |
| | GTT→ATT | V60I | TCT→CCT | S215P | | | |

TABLE 23-continued

CVS Variants

| Mutant | Nucleotide changes vs. wildtype | Amino acid changes vs. wildtype | Nucleotide changes vs. CVS V19 | Amino acid changes vs. CVS V19 | SEQ ID NO nt | SEQ ID NO aa | Valencene production % vs. V19 (Shake Flask) |
|---|---|---|---|---|---|---|---|
| | AAA→CAA | K88Q | ACT→CCC | T216P | | | |
| | TAT→CAT | Y93H | TCT→TTC | S217F | | | |
| | AAT→GAT | N97D | GAT→ATG | D218M | | | |
| | AGA→AAA | R98K | GAT→CAC | D219H | | | |
| | AAG→CAA | K125Q | TTG→CCC | L220P | | | |
| | AAG→CAA | K173Q | GTT→TGC | V221C | | | |
| | AAG→AGA | K184R | TTG→TGC | L313C | | | |
| | TTT→ATT | F209I | TCT→ACG | S314T | | | |
| | ATG→TCC | M212S | TTG→ATG | L315M | | | |
| | ATC→CTG | I213L | ACC→AGT | T317S | | | |
| | AAT→GAA | N214E | *GAC→GAT* | *D329D* | | | |
| | TCA→CCT | S215P | AAG→CGA | K336R | | | |
| | ACA→CCC | T216P | TTA→ATT | L337I | | | |
| | AGT→TTC | S217F | GGT→CGG | G357R | | | |
| | GAT→ATG | D218M | | | | | |
| | *CAT→CAC* | *H219H* | | | | | |
| | TTA→CCC | L220P | | | | | |
| | TAC→TGC | Y221C | | | | | |
| | GAG→GAT | E238D | | | | | |
| | AAA→CAA | K252Q | | | | | |
| | *GGG→GGT* | *G276G* | | | | | |
| | CAA→AAA | Q292K | | | | | |
| | CTC→TGC | L313C | | | | | |
| | AGC→ACG | S314T | | | | | |
| | CTC→ATG | L315M | | | | | |
| | ACT→AGT | T317S | | | | | |
| | CAA→GCT | Q321A | | | | | |
| | GAA→GAT | E333D | | | | | |
| | AAA→CGA | K336R | | | | | |
| | TTG→ATT | L337I | | | | | |
| | GCT→ACA | A345T | | | | | |
| | GGA→CGG | G357R | | | | | |
| | AAT→ATT | N369I | | | | | |
| | TCT→TAC | S377Y | | | | | |
| | ACA→AGA | T405R | | | | | |
| | AAT→GGT | N429G | | | | | |
| | GCA→TCT | A436S | | | | | |
| | ACC→CCA | T501P | | | | | |
| | GAT→GAA | D536E | | | | | |
| V223 | AAA→CAA | K24Q | *GAA→GAG* | *E163E* | 775 | 832 | 78.9 |
| | CAA→AAT | Q38N | AGA→GCG | R212A | | | (688 mg/L) |
| | AAG→CAA | K58Q | *ATT→ATC* | *I213I* | | | |
| | GTT→ATT | V60I | GAT→TAT | D214Y | | | |
| | AAA→CAA | K88Q | TCT→GCA | S215A | | | |
| | TAT→CAT | Y93H | ACT→AGG | T216R | | | |
| | AAT→GAT | N97D | TCT→ACA | S217T | | | |
| | AGA→AAA | R98K | GAT→GGA | D218G | | | |
| | AAG→CAA | K125Q | GAT→CGC | D219R | | | |
| | AAG→CAA | K173Q | TTG→ATG | L220M | | | |
| | AAG→AGA | K184R | GTT→AAC | V221N | | | |
| | *GAA→GAG* | *E163E* | TTG→TGC | L313C | | | |
| | TTT→ATT | F209I | TCT→ACG | S314T | | | |
| | ATG→GCG | M212A | TTG→ATG | L315M | | | |
| | AAT→TAT | N214Y | ACC→AGT | T317S | | | |
| | TCA→GCA | S215A | GAC→GAT | D329D | | | |
| | ACA→AGG | T216R | AAG→CGA | K336R | | | |
| | AGT→ACA | S217T | TTA→ATT | L337I | | | |
| | GAT→GGA | D218G | GGT→CGG | G357R | | | |
| | CAT→CGC | H219R | | | | | |
| | TTA→ATG | L220M | | | | | |
| | TAC→AAC | Y221N | | | | | |
| | GAG→GAT | E238D | | | | | |
| | AAA→CAA | K252Q | | | | | |
| | *GGG→GGT* | *G276G* | | | | | |
| | CAA→AAA | Q292K | | | | | |
| | CTC→TGC | L313C | | | | | |
| | AGC→ACG | S314T | | | | | |
| | CTC→ATG | L315M | | | | | |
| | ACT→AGT | T317S | | | | | |
| | CAA→GCT | Q321A | | | | | |

TABLE 23-continued

| CVS Variants | | | | | | | |
|---|---|---|---|---|---|---|---|
| Mutant | Nucleotide changes vs. wildtype | Amino acid changes vs. wildtype | Nucleotide changes vs. CVS V19 | Amino acid changes vs. CVS V19 | SEQ ID NO nt | SEQ ID NO aa | Valencene production % vs. V19 (Shake Flask) |
| | GAA→GAT | E333D | | | | | |
| | AAA→CGA | K336R | | | | | |
| | TTG→ATT | L337I | | | | | |
| | GCT→ACA | A345T | | | | | |
| | GGA→CGG | G357R | | | | | |
| | AAT→ATT | N369I | | | | | |
| | TCT→TAC | S377Y | | | | | |
| | ACA→AGA | T405R | | | | | |
| | AAT→GGT | N429G | | | | | |
| | GCA→TCT | A436S | | | | | |
| | ACC→CCA | T501P | | | | | |
| | GAT→GAA | D536E | | | | | |
| V224 | AAA→CAA | K24Q | *GAA→GAG* | *E42E* | 720 | 749 | 77 |
| | CAA→AAT | Q38N | AGA→AAT | R212N | | | (675 mg/L) |
| | AAG→CAA | K58Q | ATT→ATG | I213M | | | |
| | GTT→ATT | V60I | GAT→TCT | D214S | | | |
| | AAA→CAA | K88Q | *TCT→TCG* | *S215S* | | | |
| | TAT→CAT | Y93H | ACT→TAC | T216Y | | | |
| | AAT→GAT | N97D | TCT→CGG | S217R | | | |
| | AGA→AAA | R98K | GAT→GGG | D218G | | | |
| | AAG→CAA | K125Q | GAT→TGC | D219C | | | |
| | AAG→CAA | K173Q | TTG→AGC | L220S | | | |
| | AAG→AGA | K184R | *GTT→GTG* | *V221V* | | | |
| | TTT→ATT | F209I | *GGT→GGG* | *G276G* | | | |
| | ATG→AAT | M212N | CCA→TCA | P281S | | | |
| | ATC→ATG | I213M | TTG→TGC | L313C | | | |
| | AAT→TCT | N214S | TCT→ACG | S314T | | | |
| | *TCA→TCG* | *S215S* | TTG→ATG | L315M | | | |
| | ACA→TAC | T216Y | ACC→AGT | T317S | | | |
| | AGT→CGG | S217R | GCT→ACT | A319T | | | |
| | GAT→GGG | D218G | *GAC→GAT* | *D329D* | | | |
| | CAT→TGC | H219C | AAG→CGA | K336R | | | |
| | TTA→AGC | L220S | TTA→ATT | L337I | | | |
| | TAC→GTG | Y221V | | | | | |
| | GAG→GAT | E238D | | | | | |
| | AAA→CAA | K252Q | | | | | |
| | CCT→TCA | P281S | | | | | |
| | CAA→AAA | Q292K | | | | | |
| | CTC→TGC | L313C | | | | | |
| | AGC→ACG | S314T | | | | | |
| | CTC→ATG | L315M | | | | | |
| | ACT→AGT | T317S | | | | | |
| | GCA→ACT | A319T | | | | | |
| | CAA→GCT | Q321A | | | | | |
| | GAA→GAT | E333D | | | | | |
| | AAA→CGA | K336R | | | | | |
| | TTG→ATT | L337I | | | | | |
| | GCT→ACA | A345T | | | | | |
| | *GGA→GGT* | *G357G* | | | | | |
| | AAT→ATT | N369I | | | | | |
| | TCT→TAC | S377Y | | | | | |
| | ACA→AGA | T405R | | | | | |
| | AAT→GGT | N429G | | | | | |
| | GCA→TCT | A436S | | | | | |
| | ACC→CCA | T501P | | | | | |
| | GAT→GAA | D536E | | | | | |
| V225 | AAA→CAA | K24Q | AGA→GAT | R212D | 721 | 750 | 76 |
| | CAA→AAT | Q38N | ATT→GCA | I213A | | | (668 mg/L) |
| | AAG→CAA | K58Q | GAT→AAC | D214N | | | |
| | GTT→ATT | V60I | TCT→GGT | S215G | | | |
| | AAA→CAA | K88Q | ACT→GAA | T216E | | | |
| | TAT→CAT | Y93H | TCT→AAG | S217K | | | |
| | AAT→GAT | N97D | GAT→GTC | D218V | | | |
| | AGA→AAA | R98K | GAT→TTG | D219L | | | |
| | AAG→CAA | K125Q | TTG→AGT | L220S | | | |
| | AAG→CAA | K173Q | GTT→TTT | V221F | | | |
| | AAG→AGA | K184R | *GGT→GGG* | *G276G* | | | |
| | TTT→ATT | F209I | CCA→TCA | P281S | | | |
| | ATG→GAT | M212D | TTG→TGC | L313C | | | |

TABLE 23-continued

CVS Variants

| Mutant | Nucleotide changes vs. wildtype | Amino acid changes vs. wildtype | Nucleotide changes vs. CVS V19 | Amino acid changes vs. CVS V19 | SEQ ID NO nt | SEQ ID NO aa | Valencene production % vs. V19 (Shake Flask) |
|---|---|---|---|---|---|---|---|
| | ATC→GCA | I213A | TCT→ACG | S314T | | | |
| | *AAT→AAC* | *N214N* | TTG→ATG | L315M | | | |
| | TCA→GGT | S215G | ACC→AGT | T317S | | | |
| | ACA→GAA | T216E | *GAC→GAT* | *D329D* | | | |
| | AGT→AAG | S217K | AAG→CGA | K336R | | | |
| | GAT→GTC | D218V | TTA→ATT | L337I | | | |
| | CAT→TTG | H219L | GGT→CGG | G357R | | | |
| | TTA→AGT | L220S | | | | | |
| | TAC→TTT | Y221F | | | | | |
| | GAG→GAT | E238D | | | | | |
| | AAA→CAA | K252Q | | | | | |
| | CCT→TCA | P281S | | | | | |
| | CAA→AAA | Q292K | | | | | |
| | CTC→TGC | L313C | | | | | |
| | AGC→ACG | S314T | | | | | |
| | CTC→ATG | L315M | | | | | |
| | ACT→AGT | T317S | | | | | |
| | CAA→GCT | Q321A | | | | | |
| | GAA→GAT | E333D | | | | | |
| | AAA→CGA | K336R | | | | | |
| | TTG→ATT | L337I | | | | | |
| | GCT→ACA | A345T | | | | | |
| | GGA→CGG | G357R | | | | | |
| | AAT→ATT | N369I | | | | | |
| | TCT→TAC | S377Y | | | | | |
| | ACA→AGA | T405R | | | | | |
| | AAT→GGT | N429G | | | | | |
| | GCA→TCT | A436S | | | | | |
| | ACC→CCA | T501P | | | | | |
| | GAT→GAA | D536E | | | | | |
| V226 | AAA→CAA | K24Q | AGA→TCA | R212S | 722 | 751 | 98 (860 mg/L) |
| | CAA→AAT | Q38N | ATT→CGT | I213R | | | |
| | AAG→CAA | K58Q | GAT→TCC | D214S | | | |
| | GTT→ATT | V60I | TCT→AAG | S215K | | | |
| | AAA→CAA | K88Q | ACT→CCG | T216P | | | |
| | TAT→CAT | Y93H | TCT→TTT | S217F | | | |
| | AAT→GAT | N97D | GAT→TGC | D218C | | | |
| | AGA→AAA | R98K | GAT→TGG | D219W | | | |
| | AAG→CAA | K125Q | TTG→ACC | L220T | | | |
| | AAG→CAA | K173Q | GTT→TCC | V221S | | | |
| | AAG→AGA | K184R | *TCT→TCC* | *S401S* | | | |
| | TTT→ATT | F209I | | | | | |
| | ATG→TCA | M212S | | | | | |
| | ATC→CGT | I213R | | | | | |
| | AAT→TCC | N214S | | | | | |
| | TCA→AAG | S215K | | | | | |
| | ACA→CCG | T216P | | | | | |
| | AGT→TTT | S217F | | | | | |
| | GAT→TGC | D218C | | | | | |
| | CAT→TGG | H219W | | | | | |
| | TTA→ACC | L220T | | | | | |
| | TAC→TCC | Y221S | | | | | |
| | GAG→GAT | E238D | | | | | |
| | AAA→CAA | K252Q | | | | | |
| | CAA→AAA | Q292K | | | | | |
| | CAA→GCT | Q321A | | | | | |
| | GAA→GAT | E333D | | | | | |
| | GCT→ACA | A345T | | | | | |
| | AAT→ATT | N369I | | | | | |
| | TCT→TAC | S377Y | | | | | |
| | *AGT→TCC* | *S401S* | | | | | |
| | ACA→AGA | T405R | | | | | |
| | AAT→GGT | N429G | | | | | |
| | GCA→TCT | A436S | | | | | |
| | ACC→CCA | T501P | | | | | |
| | GAT→GAA | D536E | | | | | |

e. CVS Variant V227

CVS variant V227 was generated by a single PCR reaction from the V75 gene using forward and reverse primers that introduce a mutation at amino acid residue F209. CVS variant V227, including amino acid and nucleotide changes versus both wildtype CVS and CVS V19, and valencene production % versus CVS V19 is set forth in Table 24 below.

these variants. For each loop to be mutated, a pair of complementary mutagenic primers was synthesized, with each primer containing 15-20 base pairs of sequence identity on each side of the amino acid positions to be swapped. In some instances, random nucleotides were present at multiple codons in the loop targeted for mutagenesis.

TABLE 24

| CVS Variant | | | | | | | |
|---|---|---|---|---|---|---|---|
| Mutant | Nucleotide changes vs. wildtype | Amino acid changes vs. wildtype | Nucleotide changes vs. CVS V19 | Amino acid changes vs. CVS V19 | SEQ ID NO nt | SEQ ID NO aa | Valencene production % vs. V19 (Shake Flask) |
| V227 | AAA→CAA | K24Q | *CAA→CAG* | *Q142Q* | 800 | 857 | 85% |
| | CAA→AAT | Q38N | ATT→CAC | I209H | | | |
| | AAG→CAA | K58Q | *GGT→GGG* | *G276G* | | | |
| | GTT→ATT | V60I | CCA→TCA | P281S | | | |
| | AAA→CAA | K88Q | TTG→TGC | L313C | | | |
| | TAT→CAT | Y93H | TCT→ACG | S314T | | | |
| | AAT→GAT | N97D | TTG→ATG | L315M | | | |
| | AGA→AAA | R98K | ACC→AGT | T317S | | | |
| | AAG→CAA | K125Q | *GAC→GAT* | *D329D* | | | |
| | *CAA→CAG* | *Q142Q* | AAG→CGA | K336R | | | |
| | AAG→CAA | K173Q | TTA→ATT | L337I | | | |
| | AAG→AGA | K184R | GGT→CGG | G357R | | | |
| | TTT→CAC | F209H | | | | | |
| | ATG→AGA | M212R | | | | | |
| | AAT→GAT | N214D | | | | | |
| | CAT→GAT | H219D | | | | | |
| | TAC→GTT | Y221V | | | | | |
| | GAG→GAT | E238D | | | | | |
| | AAA→CAA | K252Q | | | | | |
| | CCT→TCA | P281S | | | | | |
| | CAA→AAA | Q292K | | | | | |
| | CTC→TGC | L313C | | | | | |
| | AGC→ACG | S314T | | | | | |
| | CTC→ATG | L315M | | | | | |
| | ACT→AGT | T317S | | | | | |
| | CAA→GCT | Q321A | | | | | |
| | GAA→GAT | E333D | | | | | |
| | AAA→CGA | K336R | | | | | |
| | TTG→ATT | L337I | | | | | |
| | GCT→ACA | A345T | | | | | |
| | GGA→CGG | G357R | | | | | |
| | AAT→ATT | N369I | | | | | |
| | TCT→TAC | S377Y | | | | | |
| | ACA→AGA | T405R | | | | | |
| | AAT→GGT | N429G | | | | | |
| | GCA→TCT | A436S | | | | | |
| | ACC→CCA | T501P | | | | | |
| | GAT→GAA | D536E | | | | | |

Example 5

Variants Containing Domains or Regions from Other Terpene Synthases

In this example, CVS variants were generated containing heterologous amino acids from 5-epi-aristolochene synthase from *Nicotiana tabacum* (TEAS, SEQ ID NO:941), premnaspirodiene synthase from *Hyoscyamus muticus* (HPS, SEQ ID NO:942) or valencene synthase from *Vitis vinifera* (SEQ ID NO:346). The mutants were generated as described below and in subsections a-k.

In general, the CVS variants were generated by a modification of the PCR method as described in Example 3.C.1. above, using primers that introduce mutations at multiple codon positions simultaneously.

Overlapping PCR was used to generate multiple mutations in specific surface loops of V75, V19, or later derivatives of Mutagenic primers for the desired loop change were used in PCR reactions with either the upstream primer 11-154.3 (SEQ ID NO:928) or the downstream primer 11-154.4 (SEQ ID NO:927) to generate two PCR products, each containing either random nucleotides or codons from heterologous valencene synthase genes at the desired codons. PCR conditions were one cycle at 96° C. for 2 minutes and then 20-30 cycles of 94° C. for 30 seconds, 50° C. for 30 seconds, and 72° C. for 2 minutes. Only a single stage of PCR was performed for each reaction. Each resulting PCR-generated gene fragment had 30-200 nucleotides of overlap with the YEp-CVS-ura vector on the outer end, and with the compatible PCR product on the inner end.

The PCR reactions were run on a 1% agarose gel and the bands containing the designed fragment sizes were excised from the gel. The DNA was then eluted using a Qiaquick column (Qiagen). The YEp-CVS-ura vector was digested with restriction enzymes KpnI and XbaI and purified on a 1% agarose gel and the bands containing the ~6.4 kb fragment were excised from the gel. The DNA was then eluted using a Qiaquick column (Qiagen).

Approximately 250 ng of clean, digested, plasmid DNA and 250 ng of each clean PCR product were mixed, and the mixture was transformed directly into *Saccharomyces cerevisiae* strain Alx7-95 using a lithium acetate yeast transformation kit from Sigma-Aldrich. Transformants having generated a complete plasmid by yeast homologous recombination were selected on SDE agar medium (0.67% Bacto yeast nitrogen base without amino acids, 2% glucose, 0.14% yeast synthetic drop-out medium without uracil, leucine, histidine, tryptophan, 40 mg/L ergosterol) after three days growth at 28-30° C.

All of the generated mutants were screened in ALX7-95 using the microvial method described in Example 3.C.2, above, and mutants with >110% valencene productivity of CVS V19 (i.e., 10% increase in valencene versus CVS V19) were further screened in shake flask cultures. The identified mutants were sequenced. Tables 26-37 below sets forth the identified mutants, including the nucleic acid and amino acid mutations, and the percent (%) valencene production in initial microcultures and shake flask cultures relative to the valencene production of transformants containing the CVS V19 gene.

In some instances, the nucleic acid mutation was silent such that the amino acid sequence of resulting valencene synthase was the same as that of CVS V19. In addition, the nucleic acid encoding the mutant CVS V19 (SEQ ID NO:129) is codon optimized for yeast. Silent mutations that differ from those found in CVS V19 (see Table 11) are indicated in italic font. Several mutants contain the mutation Q58K. Parental gene CVS V19 contains the mutation K58Q. Thus, compared to wildtype CVS, this mutation is silent, albeit with a change in the nucleic acid codon (AAG in wildtype CVS, AAA in the mutant CVS). In the table below, dashes indicate deletions or insertions. For example, nucleotides corresponding to L175 and V176 are deleted in V232, thus the resulting variant is 2 amino acids shorter than wildtype CVS. Conversely, V239 contains 3 amino acid insertions at residues R91, A92 and D93.

TABLE 25

| Oligos for PCR | | |
|---|---|---|
| Primer | Sequence | SEQ ID NO |
| TEAS53-58 | | |
| downstream: 7-10.4 | ACTTGACCAAACCTCTGGCG | 339 |
| upstream: 7-10.3 | CCAAGCTGAATTCGAGCTCG | 338 |
| Mutagenic 1: 21-108-3 | GTTAGAAGAATGATTTTAGCAACCGGAAGGAAACCAATTCAAAAATTG | 342 |
| Mutagenic 2: 21-108-4 | CAATTTTTGAATTGGTTTCCTTCCGGTTGCTAAAATCATTCTTCTAAC | 343 |
| Upstream and Downstream primers | | |
| downstream 11-154.4 | AGCCGACAACCTTGATTGGAGACT | 927 |
| upstream 11-154.3 | AATGAGCAACGGTATACGGC | 928 |
| CVS 85-99 with HPS 93-110 | | |
| 21-130.3 | CATTTACAGAGCTGATCCTTATTTTGAGGCTCATGAATACAATGATT TGCATACTGTTTC | 929 |
| 21-130.4 | AAATAAGGATCAGCTCTGTAAATGTGATCCAACATATCTTCAATTTC TTTTTCAAAATGG | 930 |
| CVS 85-99 with Vitis 96-112 | | |
| 21-141.7 | GAAAAAGAAATTGAAGATGCATTACAACATATTTGTAATAGTTTTCA TGACTGCAATGATATGGATGGTGATTTGCATACTGTTTC | 931 |
| 21-141.8 | GAAACAGTATGCAAATCACCATCCATATCATTGCAGTCATGAAAACT ATTACAAATATGTTGTAATGCATCTTCAATTTCTTTTTC | 932 |
| CVS90-99 with Vitis 101-113 | | |
| 21-141.3 | GCTATTCAACAATTGTGTAATAGTTTTCATGACTGCAATGAT ATGGATGGTGATTTGCATACTGTTTC | 1002 |
| 21-141.4 | GAAACAGTATGCAAATCACCATCCATATCATTGCAGTCATGA AAACTATTACACAATTGTTGAATAGC | 1003 |

TABLE 25-continued

Oligos for PCR

| Primer | Sequence | SEQ ID NO |
|---|---|---|
| CVS 115-146 with Vitis 128-159 | | |
| 21-145.29 | CATTTCAGATTGTTGAGACAACAAGGGTACACTATTTCATGTG | 1004 |
| 21-145.30 | CACATGAAATAGTGTACCCTTGTTGTCTCAACAATCTGAAATG | 1005 |
| 21-145.39 | GATGTAAGAGGCATGCTAGGCTTGTATGAAGCTGCTTATATG | 1006 |
| 21-145.40 | CATATAAGCAGCTTCATACAAGCCTAGCATGCCTCTTACATC | 1007 |
| CVS 174-184 with HPS 185-193 or TEAS 177-185 | | |
| 21-134.9 | TCTGCAGCTCCACATTTGAAGTCACCTTTGGCTGAACAAATTAAC | 933 |
| 21-134.10 | AGGTGACTTCAAATGTGGAGCTGCAGATTGCAAATGAGTAGTAG | 934 |
| CVS 212-221 with HPS 221-228 | | |
| 21-141.5 | GCAAGATACATTATGTCAATCTACGAAGAGGAGGAATTTAAGAACAA GACTTTGTTAAATTTC | 935 |
| 21-141.6 | GAAATTTAACAAAGTCTTGTTCTTAAATTCCTCCTCTTCGTAGATTG ACATAATGTATCTTGC | 936 |
| CVS 212-221 with TEAS 213-221 | | |
| 21-145.1 | GCAAGATACATTATGTCATCAATCTATGACAAGGAACAATCGAAGAA CAAGACTTTGTTAAATTTC | 937 |
| 21-145.2 | GAAATTTAACAAAGTCTTGTTCTTCGATTGTTCCTTGTCATAGATTG ATGACATAATGTATCTTGC | 938 |
| CVS 212-221 with Vitis 223-230 | | |
| 21-145.3 | GCAAGATACATTATGTCAGTCTACCAAGATGAAGCTTTCCATAACAA GACTTTGTTAAATTTC | 939 |
| 21-145.4 | GAAATTTAACAAAGTCTTGTTATGGAAAGCTTCATCTTGGTAGACTG ACATAATGTATCTTGC | 940 |
| CVS 212-221 random primer | | |
| 21-140.1 | GAAGCAAGATACATTATGTCANNNNNNNNNNNNNNNNNNNNNNNNNNN NNNNAACAAGACTTTGTTAAATTTCG | 902 |
| 21-140.2 | CGAAATTTAACAAAGTCTTGTTNNNNNNNNNNNNNNNNNNNNNNNNNN NNNNNTGACATAATGTATCTTGCTTC | 903 |

a. V228, V229, V230 and V231

In CVS variants V228, V229, V230 and V231, amino acids 53-58 of CVS were replaced by amino acids 58-63 of TEAS (SEQ ID NO:295) as described above with primers 7-10.4 and 7-10.3 (see Table 25). CVS variant V229 was generated by recombination of mutation in variants V228 and V73 using standard recombinant DNA and PCR methods. CVS variants V230 and V231 were generated by recombination of mutations in variants V228 and V75. The variants, including amino acid and nucleotide changes versus both wildtype CVS and CVS V19, and valencene production % versus CVS V19 are set forth in Tables 26-27 below.

TABLE 26

CVS Variant V228

| Mutant | Nucleotide changes vs. wildtype | Amino acid changes vs. wildtype | Nucleotide changes vs. CVS V19 | Amino acid changes vs. CVS V19 | SEQ ID NO nt | SEQ ID NO aa | Initial micro-culture % vs. V19 | Valencene production % vs. V19 (Shake Flask) |
|---|---|---|---|---|---|---|---|---|
| V228 | AAA→CAA | K24Q | ACT→TTA | T53L | 203 | 67 | 102.52 | ND |
| | CAA→AAT | Q38N | GAT→GCA | D54A | | | | |
| | ACA→TTA | T53L | GCA→ACC | A55T | | | | |
| | GAT→GCA | D54A | GAA→GGA | E56G | | | | |

TABLE 26-continued

CVS Variant V228

| Mutant | Nucleotide changes vs. wildtype | Amino acid changes vs. wildtype | Nucleotide changes vs. CVS V19 | Amino acid changes vs. CVS V19 | SEQ ID NO nt | SEQ ID NO aa | Initial micro-culture % vs. V19 | Valencene production % vs. V19 (Shake Flask) |
|---|---|---|---|---|---|---|---|---|
| | GCT→ACC | A55T | GAT→AGG | D57R | | | | |
| | GAA→GGA | E56G | CAA→AAA | Q58K | | | | |
| | GAT→AGG | D57R | | | | | | |
| | *AAG→AAA* | *K58K* | | | | | | |
| | GTT→ATT | V60I | | | | | | |
| | AAA→CAA | K88Q | | | | | | |
| | TAT→CAT | Y93H | | | | | | |
| | AAT→GAT | N97D | | | | | | |
| | AGA→AAA | R98K | | | | | | |
| | AAG→CAA | K125Q | | | | | | |
| | AAG→CAA | K173Q | | | | | | |
| | AAG→AGA | K184R | | | | | | |
| | TTT→ATT | F209I | | | | | | |
| | ATG→AGA | M212R | | | | | | |
| | AAT→GAT | N214D | | | | | | |
| | CAT→GAT | H219D | | | | | | |
| | TAC→GTT | Y221V | | | | | | |
| | GAG→GAT | E238D | | | | | | |
| | AAA→CAA | K252Q | | | | | | |
| | CAA→AAA | Q292K | | | | | | |
| | CAA→GCT | Q321A | | | | | | |
| | GAA→GAT | E333D | | | | | | |
| | GCT→ACA | A345T | | | | | | |
| | AAT→ATT | N369I | | | | | | |
| | TCT→TAC | S377Y | | | | | | |
| | ACA→AGA | T405R | | | | | | |
| | AAT→GGT | N429G | | | | | | |
| | GCA→TCT | A436S | | | | | | |
| | ACC→CCA | T501P | | | | | | |
| | GAT→GAA | D536E | | | | | | |

TABLE 27

CVS Variants

| Mutant | Nucleotide changes vs. wildtype | Amino acid changes vs. wildtype | Nucleotide changes vs. CVS V19 | Amino acid changes vs. CVS V19 | SEQ ID NO nt | SEQ ID NO aa | Valencene production % vs. V19 (Shake Flask) |
|---|---|---|---|---|---|---|---|
| V229 | AAA→CAA | K24Q | ACT→TTA | T53L | 352 | 350 | 91.67 |
| (V228 | CAA→AAT | Q38N | GAT→GCA | D54A | | | |
| and | ACA→TTA | T53L | GCA→ACC | A55T | | | |
| V73) | GAT→GCA | D54A | GAA→GGA | E56G | | | |
| | GCT→ACC | A55T | GAT→AGG | D57R | | | |
| | GAA→GGA | E56G | CAA→AAA | Q58K | | | |
| | GAT→AGG | D57R | *GGT→GGG* | G276G | | | |
| | *AAG→AAA* | K58K | CCA→TCA | P281S | | | |
| | GTT→ATT | V60I | TTG→TGC | L313C | | | |
| | AAA→CAA | K88Q | TCT→ACG | S314T | | | |
| | TAT→CAT | Y93H | TTG→ATG | L315M | | | |
| | AAT→GAT | N97D | ACC→AGT | T317S | | | |
| | AGA→AAA | R98K | AAG→CGA | K336R | | | |
| | AAG→CAA | K125Q | TTA→ATA | L337I | | | |
| | AAG→CAA | K173Q | AAC→TTG | N347L | | | |
| | AAG→AGA | K184R | GGT→CGT | G357R | | | |
| | TTT→ATT | F209I | | | | | |
| | ATG→AGA | M212R | | | | | |
| | AAT→GAT | N214D | | | | | |
| | CAT→GAT | H219D | | | | | |
| | TAC→GTT | Y221V | | | | | |
| | GAG→GAT | E238D | | | | | |
| | AAA→CAA | K252Q | | | | | |
| | CCT→TCA | P281S | | | | | |
| | CAA→AAA | Q292K | | | | | |
| | CTC→TGC | L313C | | | | | |

TABLE 27-continued

| CVS Variants | | | | | | | |
|---|---|---|---|---|---|---|---|
| Mutant | Nucleotide changes vs. wildtype | Amino acid changes vs. wildtype | Nucleotide changes vs. CVS V19 | Amino acid changes vs. CVS V19 | SEQ ID NO nt | SEQ ID NO aa | Valencene production % vs. V19 (Shake Flask) |
| | AGC→ACG | S314T | | | | | |
| | CTC→ATG | L315M | | | | | |
| | ACT→AGT | T317S | | | | | |
| | CAA→GCT | Q321A | | | | | |
| | GAA→GAT | E333D | | | | | |
| | AAA→CGA | K336R | | | | | |
| | TTG→ATA | L337I | | | | | |
| | GCT→ACA | A345T | | | | | |
| | AAT→TTG | N347L | | | | | |
| | GGA→CGT | G357R | | | | | |
| | AAT→ATT | N369I | | | | | |
| | TCT→TAC | S377Y | | | | | |
| | ACA→AGA | T405R | | | | | |
| | AAT→GGT | N429G | | | | | |
| | GCA→TCT | A436S | | | | | |
| | ACC→CCA | T501P | | | | | |
| | GAT→GAA | D536E | | | | | |
| V230 | AAA→CAA | K24Q | ACT→TTA | T53L | 353 | 351 | ND |
| V231 | CAA→AAT | Q38N | GAT→GCA | D54A | | | |
| (V228 | ACA→TTA | T53L | GCA→ACC | A55T | | | |
| and | GAT→GCA | D54A | GAA→GGA | E56G | | | |
| V75) | GCT→ACC | A55T | GAT→AGG | D57R | | | |
| | GAA→GGA | E56G | CAA→AAA | Q58K | | | |
| | GAT→AGG | D57R | *GGT→GGG* | G276G | | | |
| | *AAG→AAA* | K58K | CCA→TCA | P281S | | | |
| | GTT→ATT | V60I | TTG→TGC | L313C | | | |
| | AAA→CAA | K88Q | TCT→ACG | S314T | | | |
| | TAT→CAT | Y93H | TTG→ATG | L315M | | | |
| | AAT→GAT | N97D | ACC→AGT | T317S | | | |
| | AGA→AAA | R98K | *GAC→GAT* | D329D | | | |
| | AAG→CAA | K125Q | AAG→CGA | K336R | | | |
| | AAG→CAA | K173Q | TTA→ATT | L337I | | | |
| | AAG→AGA | K184R | GGT→CGG | G357R | | | |
| | TTT→ATT | F209I | | | | | |
| | ATG→AGA | M212R | | | | | |
| | AAT→GAT | N214D | | | | | |
| | CAT→GAT | H219D | | | | | |
| | TAC→GTT | Y221V | | | | | |
| | GAG→GAT | E238D | | | | | |
| | AAA→CAA | K252Q | | | | | |
| | CAA→AAA | Q292K | | | | | |
| | CCT→TCA | P281S | | | | | |
| | CTC→TGC | L313C | | | | | |
| | AGC→ACG | S314T | | | | | |
| | CTC→ATG | L315M | | | | | |
| | ACT→AGT | T317S | | | | | |
| | CAA→GCT | Q321A | | | | | |
| | GAA→GAT | E333D | | | | | |
| | AAA→CGA | K336R | | | | | |
| | TTG→ATT | L337I | | | | | |
| | GCT→ACA | A345T | | | | | |
| | GGA→CGG | G357R | | | | | |
| | AAT→ATT | N369I | | | | | |
| | TCT→TAC | S377Y | | | | | |
| | ACA→AGA | T405R | | | | | |
| | AAT→GGT | N429G | | | | | |
| | GCA→TCT | A436S | | | | | |
| | ACC→CCA | T501P | | | | | |
| | GAT→GAA | D536E | | | | | |

b. V232, V233, V234, V235, V236, V237 and V238

In CVS variants V232, V233, V234, V235, V236, V237 and V238, amino acids 174-184 were replaced by the equivalent amino acids from HPS (amino acids 185-193 of SEQ ID NO:942) by the direct yeast recombination method as described above using mutagenic primers 21-134.9 and 21-134.10 with outer primers 11-154.3 and 11-54.4 (see Table 25). CVS variants V232, V233, V234, V235 and V236 were generated using V75 (SEQ ID NO:130) as a template. CVS variant V237 was generated by recombination of mutations in V235 and V236. This variant additionally contained a mutation at E484 generated by a random PCR error. V237 was isolated from Alx7-95 and was sequenced. In parallel, V237 was transformed into Alx11-30 for testing in that strain.

V238 was re-isolated from Alx11-30. The variants, including amino acid and nucleotide changes versus both wildtype CVS and CVS V19, and valencene production % versus CVS V19 are set forth in Table 28 below. All of these CVS variants contain two amino acid deletions since the corresponding sequence of HPS is 2 amino acids shorter than that of CVS.

TABLE 28

CVS Variants

| Mutant | Nucleotide changes vs. wildtype | Amino acid changes vs. wildtype | Nucleotide changes vs. CVS V19 | Amino acid changes vs. CVS V19 | SEQ ID NO nt | SEQ ID NO aa | Valencene production % vs. V19 (Shake Flask) |
|---|---|---|---|---|---|---|---|
| V232 | AAA→CAA | K24Q | *ACT→ACC* | *T168T* | 702 | 732 | 90.00 |
| V233 | CAA→AAT | Q38N | *TCA→TCT* | *S174S* | | | ND |
| V234 | AAG→CAA | K58Q | TTG→--- | L175→--- | | | 88.20 |
| V235 | GTT→ATT | V60I | GTT→--- | V176→--- | | | 82.15 |
| V236 | AAA→CAA | K88Q | CAA→GCT | Q178→A176 | | | 83.17 |
| (546 aa) | TAT→CAT | Y93H | GAT→CCA | D179→P177 | | | |
| | AAT→GAT | N97D | GTT→TTG | V181→L179 | | | |
| | AGA→AAA | R98K | ACT→AAG | T182→K180 | | | |
| | AAG→CAA | K125Q | CCA→TCA | P183→S181 | | | |
| | *ACT→ACC* | *T168T* | AGA→CCT | R184→P182 | | | |
| | AAG→CAA | K173Q | *GGT→GGG* | *G276→G274* | | | |
| | *TCA→TCT* | *S174S* | CCA→TCA | P281→S279 | | | |
| | TTG→--- | L175→--- | TTG→TGC | L313→C311 | | | |
| | GTA→--- | V176→--- | TCT→ACG | S314→T312 | | | |
| | CAG→GCT | Q178→A176 | TTG→ATG | L315→M313 | | | |
| | GAT→CCA | D179→P177 | ACC→AGT | T317→S315 | | | |
| | GTA→TTG | V181→L179 | *GAC→GAT* | *D329→D327* | | | |
| | ACC→AAG | T182→K180 | AAG→CGA | K336→R334 | | | |
| | CCT→TCA | P183→S181 | TTA→ATT | L337→I335 | | | |
| | AAG→CCT | K184→P182 | GGT→CGG | G357→R355 | | | |
| | TTT→ATT | F209→I207 | | | | | |
| | ATG→AGA | M212→R210 | | | | | |
| | AAT→GAT | N214→D212 | | | | | |
| | CAT→GAT | H219→D217 | | | | | |
| | TAC→GTT | Y221→V219 | | | | | |
| | GAG→GAT | E238→D236 | | | | | |
| | AAA→CAA | K252→Q250 | | | | | |
| | CCT→TCA | P281→S279 | | | | | |
| | CAA→AAA | Q292→K290 | | | | | |
| | CTC→TGC | L313→C311 | | | | | |
| | AGC→ACG | S314→T312 | | | | | |
| | CTC→ATG | L315→M313 | | | | | |
| | ACT→AGT | T317→S315 | | | | | |
| | CAA→GCT | Q321→A319 | | | | | |
| | GAA→GAT | E333→D331 | | | | | |
| | AAA→CGA | K336→R334 | | | | | |
| | TTG→ATT | L337→I335 | | | | | |
| | GCT→ACA | A345→T343 | | | | | |
| | GGA→CGG | G357→R355 | | | | | |
| | AAT→ATT | N369→I367 | | | | | |
| | TCT→TAC | S377→Y375 | | | | | |
| | ACA→AGA | T405→R403 | | | | | |
| | AAT→GGT | N429→G427 | | | | | |
| | GCA→TCT | A436→S434 | | | | | |
| | ACC→CCA | T501→P499 | | | | | |
| | GAT→GAA | D536→E534 | | | | | |
| V237 | TCG→CGG | S2R | TCA→CGG | S2R | 703 | 733 | 99.15 |
| V238 | TCT→GAC | S3D | TCT→GAC | S3D | | | (Alx7-95) |
| (546 aa) | GGA→AAG | G4K | GGT→AAG | G4K | | | 121 |
| | GAA→GGT | E5G | GAA→GGT | E5G | | | (Alx11-30) |
| | *ACA→ACG* | *T6T* | *ACT→ACG* | *T6T* | | | |
| | TTT→TGT | F7C | TTT→TGT | F7C | | | |
| | AAA→CAA | K24Q | *TCA→TCT* | *S174S* | | | |
| | CAA→AAT | Q38N | TTG→--- | L175→--- | | | |
| | AAG→CAA | K58Q | GTT→--- | V176→--- | | | |
| | GTT→ATT | V60I | CAA→GCT | Q178→A176 | | | |
| | AAA→CAA | K88Q | GAT→CCA | D179→P177 | | | |
| | TAT→CAT | Y93H | GTT→TTG | V181→L179 | | | |
| | AAT→GAT | N97D | ACT→AAG | T182→K180 | | | |
| | AGA→AAA | R98K | CCA→TCA | P183→S181 | | | |
| | AAG→CAA | K125Q | AGA→CCT | R184→P182 | | | |
| | AAG→CAA | K173Q | *GGT→GGG* | *G276→G274* | | | |
| | *TCA→TCT* | *S174S* | CCA→TCA | P281→S279 | | | |
| | TTG→--- | L175→--- | TTG→TGC | L313→C311 | | | |
| | GTA→--- | V176→--- | TCT→ACG | S314→T312 | | | |

TABLE 28-continued

CVS Variants

| Mutant | Nucleotide changes vs. wildtype | Amino acid changes vs. wildtype | Nucleotide changes vs. CVS V19 | Amino acid changes vs. CVS V19 | SEQ ID NO nt aa | Valencene production % vs. V19 (Shake Flask) |
|---|---|---|---|---|---|---|
| | CAG→GCT | Q178→A176 | TTG→ATG | L315→M313 | | |
| | GAT→CCA | D179→P177 | ACC→AGT | T317→S315 | | |
| | GTA→TTG | V181→L179 | *GAC→GAT* | *D329→D327* | | |
| | ACC→AAG | T182→K180 | AAG→CGA | K336→R334 | | |
| | CCT→TCA | P183→S181 | TTA→ATT | L337→I335 | | |
| | AAG→CCT | K184→P182 | GGT→CGG | G357→R355 | | |
| | TTT→ATT | F209→I207 | GAG→GAT | E484→D482 | | |
| | ATG→AGA | M212→R210 | | | | |
| | AAT→GAT | N214→D212 | | | | |
| | CAT→GAT | H219→D217 | | | | |
| | TAC→GTT | Y221→V219 | | | | |
| | GAG→GAT | E238→D236 | | | | |
| | AAA→CAA | K252→Q250 | | | | |
| | CCT→TCA | P281→S279 | | | | |
| | CAA→AAA | Q292→K290 | | | | |
| | CTC→TGC | L313→C311 | | | | |
| | AGC→ACG | S314→T312 | | | | |
| | CTC→ATG | L315→M313 | | | | |
| | ACT→AGT | T317→S315 | | | | |
| | CAA→GCT | Q321→A319 | | | | |
| | GAA→GAT | E333→D331 | | | | |
| | AAA→CGA | K336→R334 | | | | |
| | TTG→ATT | L337→I335 | | | | |
| | GCT→ACA | A345→T343 | | | | |
| | GGA→CGG | G357→R355 | | | | |
| | AAT→ATT | N369→I367 | | | | |
| | TCT→TAC | S377→Y375 | | | | |
| | ACA→AGA | T405→R403 | | | | |
| | AAT→GGT | N429→G427 | | | | |
| | GCA→TCT | A436→S434 | | | | |
| | GAA→GAT | E484→D482 | | | | |
| | ACC→CCA | T501→P499 | | | | |
| | GAT→GAA | D536→E534 | | | | |

c. V239, V240, and V241

In CVS variants V239, V240, and V241, amino acids 53-58 were replaced by amino acids 58-63 of TEAS (SEQ ID NO:941), amino acids 85-99 were replaced by amino acids 93-110 of HPS (SEQ ID NO:942) and amino acids 174-184 were replaced by amino acids 185-193 of HPS (SEQ ID NO:942) or 177-185 of TEAS (SEQ ID NO:941) by direct yeast recombination as described above (see Table 25) Amino acids 185-193 of BPS are identical to amino acids 177-185 of TEAS. These mutants were generated from two PCR fragments. To generate the first fragment, the V228 variant was used as a template with oligos 11-154.3 and mutagenic primer 21-130.4. To generate the second fragment, V237/V238 was used as a template with outer oligo 11-154.4 and mutagenic primer 21-130.3.

The variants, including amino acid and nucleotide changes versus both wildtype CVS and CVS V19, and valencene production % versus CVS V19 are set forth in Table 29 below. Use of the HPS loops to replace amino acids 85-99 and 174-184 results in the addition of three amino acid residues and the deletion of two amino acid residues, respectively, resulting in a protein that is one amino acid longer than wildtype CVS. In addition to the designed mutations from V228 and V237/V238, V239 contains a mutation at L111 that thought to be the result of a PCR error. Likewise, V240 also has a mutation at R19.

TABLE 29

CVS Variants

| Mutant | Nucleotide changes vs. wildtype | Amino acid changes vs. wildtype | Nucleotide changes vs. CVS V19 | Amino acid changes vs. CVS V19 | SEQ ID NO nt aa | Valencene production % vs. V19 (Shake Flask) |
|---|---|---|---|---|---|---|
| V239 | AAA→CAA | K24Q | ACT→TTA | T53L | 713 743 | 87.5 |
| (549 aa) | CAA→AAT | Q38N | GAT→GCA | D54A | | |
| | ACA→TTA | T53L | GCA→ACC | A55T | | |
| | GAT→GCA | D54A | GAA→GGA | E56G | | |
| | GCT→ACC | A55T | GAT→AGG | D57R | | |

TABLE 29-continued

| CVS Variants | | | | | | |
|---|---|---|---|---|---|---|
| Mutant | Nucleotide changes vs. wildtype | Amino acid changes vs. wildtype | Nucleotide changes vs. CVS V19 | Amino acid changes vs. CVS V19 | SEQ ID NO nt aa | Valencene production % vs. V19 (Shake Flask) |
| | GAA→GGA | E56G | CAA→AAA | Q58K | | |
| | GAT→AGG | D57R | GCT→ATG | A85M | | |
| | *AAG→AAA* | *K58K* | ATT→TTG | I86L | | |
| | GTT→ATT | V60I | CAA→GAT | Q87D | | |
| | GCA→ATG | A85M | CAA→CAC | Q88H | | |
| | ATA→TTG | I86L | TTG→ATT | L89I | | |
| | CAA→GAT | Q87D | TGT→TAC | C90Y | | |
| | AAA→CAC | K88H | ---→AGA | --→R91 | | |
| | TTA→ATT | L89I | ---→GCT | --→A92 | | |
| | TGT→TAC | C90Y | ---→GAT | --→D93 | | |
| | ---→AGA | ---→R91 | *CCA→CCT* | *P91→P94* | | |
| | ---→GCT | ---→A92 | ATT→TAT | I92→Y95 | | |
| | ---→GAT | ---→D93 | CAT→TTT | H93→F96 | | |
| | *CCA→CCT* | *P91→P94* | ATT→GAG | I94→E97 | | |
| | ATC→TAT | I92→Y95 | GAT→GCT | D95→A98 | | |
| | TAT→TTT | Y93→F96 | TCT→CAT | S96→H99 | | |
| | ATT→GAG | I94→E97 | GAT→GAA | D97→E100 | | |
| | GAC→GCT | D95→A98 | AAA→TAC | K98→Y101 | | |
| | AGT→CAT | S96→H99 | GCT→AAT | A99→N102 | | |
| | AAT→GAA | N97→E100 | TTG→TCG | L111→S114 | | |
| | AGA→TAC | R98→Y101 | *TCA→TCT* | *S174→S177* | | |
| | GCT→AAT | A99→N102 | TTG→--- | L175→--- | | |
| | CTT→TCG | L111→S114 | GTT→--- | V176→--- | | |
| | AAG→CAA | K125→Q128 | CAA→GCT | Q178→A179 | | |
| | AAG→CAA | K173→Q176 | GAT→CCA | D179→P180 | | |
| | *TCA→TCT* | *S174→S177* | GTT→TTG | V181→L182 | | |
| | TTG→--- | L175→--- | ACT→AAG | T182→K183 | | |
| | GTA→--- | V176→--- | CCA→TCA | P183→S184 | | |
| | CAG→GCT | Q178→A179 | AGA→CCT | R184→P185 | | |
| | GAT→CCA | D179→P180 | *GGT→GGG* | *G276→G277* | | |
| | GTA→TTG | V181→L182 | CCA→TCA | P281→S282 | | |
| | ACC→AAG | T182→K183 | TTG→TGC | L313→C314 | | |
| | CCT→TCA | P183→S184 | TCT→ACG | S314→T315 | | |
| | AAG→CCT | K184→P185 | TTG→ATG | L315→M316 | | |
| | TTT→ATT | F209→I210 | ACC→AGT | T317→S318 | | |
| | ATG→AGA | M212→R213 | *GAC→GAT* | *D329→D330* | | |
| | AAT→GAT | N214→D215 | AAG→CGA | K336→R337 | | |
| | CAT→GAT | H219→D220 | TTA→ATT | L337→I338 | | |
| | TAC→GTT | Y221→V222 | GGT→CGG | G357→R358 | | |
| | GAG→GAT | E238→D239 | GAG→GAT | E484→D485 | | |
| | AAA→CAA | K252→Q253 | | | | |
| | CCT→TCA | P281→S282 | | | | |
| | CAA→AAA | Q292→K293 | | | | |
| | *ACT→ACC* | *T303→T304* | | | | |
| | CTC→TGC | L313→C314 | | | | |
| | AGC→ACG | S314→T315 | | | | |
| | CTC→ATG | L315→M316 | | | | |
| | ACT→AGT | T317→S318 | | | | |
| | CAA→GCT | Q321→A322 | | | | |
| | GAA→GAT | E333→D334 | | | | |
| | AAA→CGA | K336→R337 | | | | |
| | TTG→ATT | L337→I338 | | | | |
| | GCT→ACA | A345→T346 | | | | |
| | GGA→CGG | G357→R358 | | | | |
| | AAT→ATT | N369→I370 | | | | |
| | TCT→TAC | S377→Y378 | | | | |
| | ACA→AGA | T405→R406 | | | | |
| | AAT→GGT | N429→G430 | | | | |
| | GCA→TCT | A436→S437 | | | | |
| | GAA→GAT | E484→D485 | | | | |
| | ACC→CCA | T501→P502 | | | | |
| | GAT→GAA | D536→E537 | | | | |
| V240 | AGA→AAA | R19K | AGA→AAA | R19K | 714 744 | 105 |
| (549 aa) | AAA→CAA | K24Q | ACT→TTA | T53L | | |
| | CAA→AAT | Q38N | GAT→GCA | D54A | | |
| | ACA→TTA | T53L | GCA→ACC | A55T | | |

TABLE 29-continued

CVS Variants

| Mutant | Nucleotide changes vs. wildtype | Amino acid changes vs. wildtype | Nucleotide changes vs. CVS V19 | Amino acid changes vs. CVS V19 | SEQ ID NO nt aa | Valencene production % vs. V19 (Shake Flask) |
|---|---|---|---|---|---|---|
| | GAT→GCA | D54A | GAA→GGA | E56G | | |
| | GCT→ACC | A55T | GAT→AGG | D57R | | |
| | GAA→GGA | E56G | CAA→AAA | Q58K | | |
| | GAT→AGG | D57R | GCT→ATG | A85M | | |
| | *AAG→AAA* | *K58K* | ATT→TTG | I86L | | |
| | GTT→ATT | V60I | CAA→GAT | Q87D | | |
| | GCA→ATG | A85M | CAA→CAC | Q88H | | |
| | ATA→TTG | I86L | TTG→ATT | L89I | | |
| | CAA→GAT | Q87D | TGT→TAC | C90Y | | |
| | AAA→CAC | K88H | ---→AGA | ---→R91 | | |
| | TTA→ATT | L89I | ---→GCT | ---→A92 | | |
| | TGT→TAC | C90Y | ---→GAT | ---→D93 | | |
| | ---→AGA | ---→R91 | CCA→CCT | *P91→P94* | | |
| | ---→GCT | ---→A92 | ATT→TAT | I92→Y95 | | |
| | ---→GAT | ---→D93 | CAT→TTT | H93→F96 | | |
| | *CCA→CCT* | *P91→P94* | TTT→GAG | I94→E97 | | |
| | ATC→TAT | I92→Y95 | GAT→GCT | D95→A98 | | |
| | TAT→TTT | Y93→F96 | TCT→CAT | S96→H99 | | |
| | ATT→GAG | I94→E97 | CAT→GAA | D97→E100 | | |
| | GAC→GCT | D95→A98 | AAA→TAC | K98→Y101 | | |
| | AGT→CAT | S96→H99 | GCT→AAT | A99→N102 | | |
| | AAT→GAA | N97→E100 | *TCA→TCT* | *S174→S177* | | |
| | AGA→TAC | R98→Y101 | TTG→--- | L175→--- | | |
| | GCT→AAT | A99→N102 | GTT→--- | V176→--- | | |
| | AAG→CAA | K125→Q128 | CAA→GCT | Q178→A179 | | |
| | AAG→CAA | K173→Q176 | GAT→CCA | D179→P180 | | |
| | *TCA→TCT* | *S174→S177* | GTT→TTG | V181→L182 | | |
| | TTG→--- | L175→--- | ACT→AAG | T182→K183 | | |
| | GTA→--- | V176→--- | CCA→TCA | P183→S184 | | |
| | CAG→GCT | Q178→A179 | AGA→CCT | R184→P185 | | |
| | GAT→CCA | D179→P180 | *GGT→GGG* | *G276→G277* | | |
| | GTA→TTG | V181→L182 | CCA→TCA | P281→S282 | | |
| | ACC→AAG | T182→K183 | TTG→TGC | L313→C314 | | |
| | CCT→TCA | P183→S184 | TCT→ACG | S314→T315 | | |
| | AAG→CCT | K184→P185 | TTG→ATG | L315→M316 | | |
| | TTT→ATT | F209→I210 | ACC→AGT | T317→S318 | | |
| | ATG→AGA | M212→R213 | *GAC→GAT* | *D329→D330* | | |
| | AAT→GAT | N214→D215 | AAG→CGA | K336→R337 | | |
| | CAT→GAT | H219→D220 | TTA→ATT | L337→I338 | | |
| | TAC→GTT | Y221→V222 | GGT→CGG | G357→R358 | | |
| | GAG→GAT | E238→D239 | GAG→GAT | E484→D485 | | |
| | AAA→CAA | K252→Q253 | | | | |
| | CCT→TCA | P281→S282 | | | | |
| | CAA→AAA | Q292→K293 | | | | |
| | *ACT→ACC* | *T303→T304* | | | | |
| | CTC→TGC | L313→C314 | | | | |
| | AGC→ACG | S314→T315 | | | | |
| | CTC→ATG | L315→M316 | | | | |
| | ACT→AGT | T317→S318 | | | | |
| | CAA→GCT | Q321→A322 | | | | |
| | GAA→GAT | E333→D334 | | | | |
| | AAA→CGA | K336→R337 | | | | |
| | TTG→ATT | L337→I338 | | | | |
| | GCT→ACA | A345→T346 | | | | |
| | GGA→CGG | G357→R358 | | | | |
| | AAT→ATT | N369→I370 | | | | |
| | TCT→TAC | S377→Y378 | | | | |
| | ACA→AGA | T405→R406 | | | | |
| | AAT→GGT | N429→G430 | | | | |
| | GCA→TCT | A436→S437 | | | | |
| | GAA→GAT | E484→D485 | | | | |
| | ACC→CCA | T501→P502 | | | | |
| | GAT→GAA | D536→E537 | | | | |
| V241 | AAA→CAA | K24Q | ACT→TTA | T53L | 715 745 | 77.8 |
| (549 aa) | CAA→AAT | Q38N | GAT→GCA | D54A | | |
| | ACA→TTA | T53L | GCA→ACC | A55T | | |
| | GAT→GCA | D54A | GAA→GGA | E56G | | |
| | GCT→ACC | A55T | GAT→AGG | D57R | | |
| | GAA→GGA | E56G | CAA→AAA | Q58K | | |
| | GAT→AGG | D57R | GCT→ATG | A85M | | |

TABLE 29-continued

| CVS Variants | | | | | | | |
|---|---|---|---|---|---|---|---|
| Mutant | Nucleotide changes vs. wildtype | Amino acid changes vs. wildtype | Nucleotide changes vs. CVS V19 | Amino acid changes vs. CVS V19 | SEQ ID NO nt | aa | Valencene production % vs. V19 (Shake Flask) |
| | *AAG→AAA* | *K58K* | ATT→TTG | I86L | | | |
| | GTT→ATT | V60I | CAA→GAT | Q87D | | | |
| | GCA→ATG | A85M | CAA→CAC | Q88H | | | |
| | ATA→TTG | I86L | TTG→ATT | L89I | | | |
| | CAA→GAT | Q87D | TGT→TAC | C90Y | | | |
| | AAA→CAC | K88H | ---→AGA | ---→R91 | | | |
| | TTA→ATT | L89I | ---→GCT | ---→A92 | | | |
| | TGT→TAC | C90Y | ---→GAT | ---→D93 | | | |
| | ---→AGA | ---→R91 | CCA→CCT | *P91→P94* | | | |
| | ---→GCT | ---→A92 | ATT→TAT | I92→Y95 | | | |
| | ---→GAT | ---→D93 | *CAT→TTT* | H93→F96 | | | |
| | *CCA→CCT* | *P91→P94* | ATT→GAG | I94→E97 | | | |
| | ATC→TAT | I92→Y95 | GAT→GCT | D95→A98 | | | |
| | TAT→TTT | Y93→F96 | TCT→CAT | S96→H99 | | | |
| | ATT→GAG | I94→E97 | GAT→GAA | D97→E100 | | | |
| | GAC→GCT | D95→A98 | AAA→TAC | K98→Y101 | | | |
| | AGT→CAT | S96→H99 | GCT→AAT | A99→N102 | | | |
| | AAT→GAA | N97→E100 | *TCA→TCT* | *S174→S177* | | | |
| | AGA→TAC | R98→Y101 | TTG→--- | L175→--- | | | |
| | GCT→AAT | A99→N102 | GTT→--- | V176→--- | | | |
| | AAG→CAA | K125→Q128 | CAA→GCT | Q178→A179 | | | |
| | AAG→CAA | K173→Q176 | GAT→CCA | D179→P180 | | | |
| | *TCA→TCT* | *S174→S177* | GTT→TTG | V181→L182 | | | |
| | TTG→--- | L175→--- | ACT→AAG | T182→K183 | | | |
| | GTA→--- | V176→--- | CCA→TCA | P183→S184 | | | |
| | CAG→GCT | Q178→A179 | AGA→CCT | R184→P185 | | | |
| | GAT→CCA | D179→P180 | *TTG→CTG* | *L193→L194* | | | |
| | GTA→TTG | V181→L182 | *GGT→GGG* | *G276→G277* | | | |
| | ACC→AAG | T182→K183 | CCA→TCA | P281→S282 | | | |
| | CCT→TCA | P183→S184 | TTG→TGC | L313→C314 | | | |
| | AAG→CCT | K184→P185 | TCT→ACG | S314→T315 | | | |
| | *TTA→CTG* | *L193→L194* | TTG→ATG | L315→M316 | | | |
| | TTT→ATT | F209→I210 | ACC→AGT | T317→S318 | | | |
| | ATG→AGA | M212→R213 | *GAC→GAT* | *D329→D330* | | | |
| | AAT→GAT | N214→D215 | AAG→CGA | K336→R337 | | | |
| | CAT→GAT | H219→D220 | TTA→ATT | L337→I338 | | | |
| | TAC→GTT | Y221→V222 | GGT→CGG | G357→R358 | | | |
| | GAG→GAT | E238→D239 | *GAA→GAG* | *E422→E423* | | | |
| | AAA→CAA | K252→Q253 | GAG→GAT | E484→D485 | | | |
| | CCT→TCA | P281→S282 | | | | | |
| | CAA→AAA | Q292→K293 | | | | | |
| | *ACT→ACC* | *T303→T304* | | | | | |
| | CTC→TGC | L313→C314 | | | | | |
| | AGC→ACG | S314→T315 | | | | | |
| | CTC→ATG | L315→M316 | | | | | |
| | ACT→AGT | T317→S318 | | | | | |
| | CAA→GCT | Q321→A322 | | | | | |
| | GAA→GAT | E333→D334 | | | | | |
| | AAA→CGA | K336→R337 | | | | | |
| | TTG→ATT | L337→I338 | | | | | |
| | GCT→ACA | A345→T346 | | | | | |
| | GGA→CGG | G357→R358 | | | | | |
| | AAT→ATT | N369→I370 | | | | | |
| | TCT→TAC | S377→Y378 | | | | | |
| | ACA→AGA | T405→R406 | | | | | |
| | AAT→GGT | N429→G430 | | | | | |
| | GCA→TCT | A436→S437 | | | | | |
| | GAA→GAT | E484→D485 | | | | | |
| | ACC→CCA | T501→P502 | | | | | |
| | GAT→GAA | D536→E537 | | | | | |

d. V242

In CVS variant V242, amino acids 212-222 were replaced by amino acids 221-228 of HPS by direct yeast recombination as described above (see Table 25). This CVS variant was generated from V75 as a template using outer primers 11-154.3 with mutagenic primer 21-141.6, and 11-154.4 with mutagenic primer 21-141.5. The variants, including amino acid and nucleotide changes versus both wildtype CVS and CVS V19, and valencene production % versus CVS V19 are set forth in Table 30 below. This variant contains two amino acid deletions since the corresponding sequence of HPS is 2 amino acids shorter than that of CVS.

Screening of numerous clones showed that all but V242 had titers of ~77% of V19, while V242 had a titer of 95% of the V19 titer. Sequencing revealed mutant V242 contained the sequence IYEEEGFK whereas amino acids 221-228 of HPS are IYEEEEFK. This discrepancy most likely occurred during oligo synthesis.

213-221 of TEAS or 2) amino acids 223-230 of *Vitis vinifera* valencene synthase (SEQ ID NO:346). These CVS variants were generated using V240 as a template, with primers set forth in Table 25 above.

TABLE 30

| CVS Variants | | | | | | | |
|---|---|---|---|---|---|---|---|
| Mutant | Nucleotide changes vs. wildtype | Amino acid changes vs. wildtype | Nucleotide changes vs. CVS V19 | Amino acid changes vs. CVS V19 | SEQ ID NO nt | SEQ ID NO aa | Valencene production % vs. V19 (Shake Flask) |
| V242 | AAA→CAA | K24Q | AGA→ATC | R212I | 776 | 833 | 97.2 |
| | CAA→AAT | Q38N | ATT→TAC | I213Y | | | |
| | AAG→CAA | K58Q | GAT→GAA | D214E | | | |
| | GTT→ATT | V60I | TCT→--- | S215→--- | | | |
| | AAA→CAA | K88Q | ACT→--- | T216→--- | | | |
| | TAT→CAT | Y93H | TCT→GAG | S217→E215 | | | |
| | AAT→GAT | N97D | GAT→GAG | D218→E216 | | | |
| | AGA→AAA | R98K | GAT→GGA | D219→G217 | | | |
| | AAG→CAA | K125Q | TTG→TTT | L220→F218 | | | |
| | AAG→CAA | K173Q | GTT→AAG | V221→K219 | | | |
| | AAG→AGA | K184R | *AAC→AAT* | *N222→N220* | | | |
| | TTT→ATT | F209I | *GGT→GGG* | *G276→G274* | | | |
| | ATG→ATC | M212I | CCA→TCA | P281→S279 | | | |
| | ATC→TAC | I213Y | TTG→TGC | L313→C311 | | | |
| | AAT→GAA | N214E | TCT→ACG | S314→T312 | | | |
| | TCA→--- | S215→--- | TTG→ATG | L315→M313 | | | |
| | ACA→--- | T216→--- | ACC→AGT | T317→S315 | | | |
| | AGT→GAG | S217→E215 | *GAC→GAT* | *D329→D327* | | | |
| | GAT→GAG | D218→E216 | AAG→CGA | K336→R334 | | | |
| | CAT→GGA | H219→G217 | TTA→ATT | L337→I335 | | | |
| | TTA→TTT | L220→F218 | GGT→CGG | G357→R355 | | | |
| | TAC→AAG | Y221→K219 | | | | | |
| | GAG→GAT | E238→D236 | | | | | |
| | AAA→CAA | K252→Q250 | | | | | |
| | CCT→TCA | P281→S279 | | | | | |
| | CAA→AAA | Q292→K290 | | | | | |
| | CTC→TGC | L313→C311 | | | | | |
| | AGC→ACG | S314→T312 | | | | | |
| | CTC→ATG | L315→M313 | | | | | |
| | ACT→AGT | T317→S315 | | | | | |
| | CAA→GCT | Q321→A319 | | | | | |
| | GAA→GAT | E333→D331 | | | | | |
| | AAA→CGA | K336→R334 | | | | | |
| | TTG→ATT | L337→I335 | | | | | |
| | GCT→ACA | A345→T343 | | | | | |
| | GGA→CGG | G357→R355 | | | | | |
| | AAT→ATT | N369→I367 | | | | | |
| | TCT→TAC | S377→Y375 | | | | | |
| | ACA→AGA | T405→R403 | | | | | |
| | AAT→GGT | N429→G427 | | | | | |
| | GCA→TCT | A436→S434 | | | | | |
| | ACC→CCA | T501→P499 | | | | | |
| | GAT→GAA | D536→E534 | | | | | |

e. V243, V244, V245 and V255

In CVS variants V243, V244, V245 and V255, amino acids 53-58 were replaced by amino acids 58-63 of TEAS (SEQ ID NO:941), amino acids 85-99 were replaced by amino acids 93-110 of HPS (SEQ ID NO:942) and amino acids 174-184 were replaced by amino acids 185-193 of HPS (SEQ ID NO:942) or 177-185 of TEAS (SEQ ID NO:295) by direct yeast recombination as described above (see Table 27). These variants additionally contain mutations from V75. In addition, amino acids 212-221 were replaced by 1) amino acids V243 and V244 were generated using V240 as template, with mutagenic primers 21-145.1 and 21-145.5 together with outer oligos 11-154.3 and 11-154.4 (see Table 25). The V245 and V255 CVS variants were generated using V240 as a template, with mutagenic primers 21-145.3 and 21-145.4, as set forth in Table 25 above.

The variants, including amino acid and nucleotide changes versus both wildtype CVS and CVS V19, and valencene production % versus CVS V19 are set forth in Table 31 below. V244 contains a mutation I325T that is not found in V243, presumably introduced during PCR. Variants V245 and V255, which each have the *Vitis vinifera* valencene synthase sequence at the CVS positions 212-221, differ by a single nucleotide change, presumably generated during PCR, that results in an unexpected Q448 to L447 mutation in V255.

TABLE 31

| CVS Variants | | | | | | | |
|---|---|---|---|---|---|---|---|
| Mutant | Nucleotide changes vs. wildtype | Amino acid changes vs. wildtype | Nucleotide changes vs. CVS V19 | Amino acid changes vs. CVS V19 | SEQ ID NO nt | SEQ ID NO aa | Valencene production % vs. V19 (Shake Flask) |
| V243 | AGA→AAA | R19K | AGA→AAA | R19K | 777 | 834 | 78.93 |
| | AAA→CAA | K24Q | ACT→TTA | T53L | | | |
| | CAA→AAT | Q38N | GAT→GCA | D54A | | | |
| | ACA→TTA | T53L | GCA→ACC | A55T | | | |
| | GAT→GCA | D54A | GAA→GGA | E56G | | | |
| | GCT→ACC | A55T | GAT→AGG | D57R | | | |
| | GAA→GGA | E56G | CAA→AAA | Q58K | | | |
| | GAT→AGG | D57R | GCT→ATG | A85M | | | |
| | *AAG→AAA* | *K58K* | ATT→TTG | I86L | | | |
| | GTT→ATT | V60I | CAA→GAT | Q87D | | | |
| | GCA→ATG | A85M | CAA→CAC | Q88H | | | |
| | ATA→TTG | I86L | TTG→ATT | L89I | | | |
| | CAA→GAT | Q87D | TGT→TAC | C90Y | | | |
| | AAA→CAC | K88H | ---→AGA | ---→R91 | | | |
| | TTA→ATT | L89I | ---→GCT | ---→A92 | | | |
| | TGT→TAC | C90Y | ---→GAT | ---→D93 | | | |
| | ---→AGA | ---→R91 | *CCA→CCT* | *P91→P94* | | | |
| | ---→GCT | ---→A92 | ATT→TAT | I92→Y95 | | | |
| | ---→GAT | ---→D93 | CAT→TTT | H93→F96 | | | |
| | *CCA→CCT* | *P91→P94* | TTT→GAG | I94→E97 | | | |
| | ATC→TAT | I92→Y95 | GAT→GCT | D95→A98 | | | |
| | TAT→TTT | Y93→F96 | TCT→CAT | S96→H99 | | | |
| | ATT→GAG | I94→E97 | CAT→GAA | D97→E100 | | | |
| | GAC→GCT | D95→A98 | AAA→TAC | K98→Y101 | | | |
| | AGT→CAT | S96→H99 | GCT→AAT | A99→N102 | | | |
| | AAT→GAA | N97→E100 | *TCA→TCT* | *S174→S177* | | | |
| | AGA→TAC | R98→Y101 | TTG→--- | L175→--- | | | |
| | GCT→AAT | A99→N102 | GTT→--- | V176→--- | | | |
| | AAG→CAA | K125→Q128 | CAA→GCT | Q178→A179 | | | |
| | AAG→CAA | K173→Q176 | GAT→CCA | D179→P180 | | | |
| | *TCA→TCT* | *S174→S177* | GTT→TTG | V181→L182 | | | |
| | TTG→--- | L175→--- | ACT→AAG | T182→K183 | | | |
| | GTA→--- | V176→--- | CCA→TCA | P183→S184 | | | |
| | CAG→GCT | Q178→A179 | AGA→CCT | R184→P185 | | | |
| | GAT→CCA | D179→P180 | AGA→TCA | R212→S213 | | | |
| | GTA→TTG | V181→L182 | *ATT→ATC* | *I213→I214* | | | |
| | ACC→AAG | T182→K183 | GAT→TAT | D214→Y215 | | | |
| | CCT→TCA | P183→S184 | TCT→GAC | S215→D216 | | | |
| | AAG→CCT | K184→P185 | ACT→AAG | T216→K217 | | | |
| | TTT→ATT | F209→I210 | TCT→--- | S217→--- | | | |
| | ATG→TCA | M212→S213 | GAT→GAA | D218E | | | |
| | AAT→TAT | N214→Y215 | GAT→CAA | D219Q | | | |
| | TCA→GAC | S215→D216 | TTG→TCG | L220S | | | |
| | ACA→AAG | T216→K217 | GTT→AAG | V221K | | | |
| | AGT→--- | S217→--- | *GGT→GGG* | *G276G* | | | |
| | GAT→GAA | D218E | CCA→TCA | P281S | | | |
| | CAT→CAA | H219Q | TTG→TGC | L313C | | | |
| | TTA→TCG | L220S | TCT→ACG | S314T | | | |
| | TAC→AAG | Y221K | TGG→ATG | L315M | | | |
| | GAG→GAT | E238D | ACC→AGT | T317S | | | |
| | AAA→CAA | K252Q | *GAC→GAT* | *D329D* | | | |
| | CCT→TCA | P281S | AAG→CGA | K336R | | | |
| | CAA→AAA | Q292K | TTA→ATT | L337I | | | |
| | CTC→TGC | L313C | GGT→CGG | G357R | | | |
| | AGC→ACG | S314T | GAG→GAT | E484D | | | |
| | CTC→ATG | L315M | | | | | |
| | ACT→AGT | T317S | | | | | |
| | CAA→GCT | Q321A | | | | | |
| | GAA→GAT | E333D | | | | | |
| | AAA→CGA | K336R | | | | | |
| | TTG→ATT | L337I | | | | | |
| | GCT→ACA | A345T | | | | | |
| | GGA→CGG | G357R | | | | | |
| | AAT→ATT | N369I | | | | | |
| | TCT→TAC | S377Y | | | | | |
| | ACA→AGA | T405R | | | | | |

TABLE 31-continued

CVS Variants

| Mutant | Nucleotide changes vs. wildtype | Amino acid changes vs. wildtype | Nucleotide changes vs. CVS V19 | Amino acid changes vs. CVS V19 | SEQ ID NO nt | SEQ ID NO aa | Valencene production % vs. V19 (Shake Flask) |
|---|---|---|---|---|---|---|---|
| | AAT→GGT | N429G | | | | | |
| | GCA→TCT | A436S | | | | | |
| | GAA→GAT | E484D | | | | | |
| | ACC→CCA | T501P | | | | | |
| | GAT→GAA | D536E | | | | | |
| V244 | AGA→AAA | R19K | AGA→AAA | R19K | 778 | 835 | 77.75 |
| | AAA→CAA | K24Q | ACT→TTA | T53L | | | |
| | CAA→AAT | Q38N | GAT→GCA | D54A | | | |
| | ACA→TTA | T53L | GCA→ACC | A55T | | | |
| | GAT→GCA | D54A | GAA→GGA | E56G | | | |
| | GCT→ACC | A55T | GAT→AGG | D57R | | | |
| | GAA→GGA | E56G | CAA→AAA | Q58K | | | |
| | GAT→AGG | D57R | GCT→ATG | A85M | | | |
| | *AAG→AAA* | *K58K* | ATT→TTG | I86L | | | |
| | GTT→ATT | V60I | CAA→GAT | Q87D | | | |
| | GCA→ATG | A85M | CAA→CAC | Q88H | | | |
| | ATA→TTG | I86L | TTG→ATT | L89I | | | |
| | CAA→GAT | Q87D | TGT→TAC | C90Y | | | |
| | AAA→CAC | K88H | --→AGA | --→R91 | | | |
| | TTA→ATT | L89I | ---→GCT | --→A92 | | | |
| | TGT→TAC | C90Y | ---→GAT | --→D93 | | | |
| | ---→AGA | ---→R91 | *CCA→CCT* | *P91→P94* | | | |
| | ---→GCT | ---→A92 | ATT→TAT | I92→Y95 | | | |
| | ---→GAT | ---→D93 | CAT→TTT | H93→F96 | | | |
| | *CCA→CCT* | *P91→P94* | ATT→GAG | I94→E97 | | | |
| | ATC→TAT | I92→Y95 | GAT→GCT | D95→A98 | | | |
| | TAT→TTT | Y93→F96 | TCT→CAT | S96→H99 | | | |
| | ATT→GAG | I94→E97 | GAT→GAA | D97→E100 | | | |
| | GAC→GCT | D95→A98 | AAA→TAC | K98→Y101 | | | |
| | AGT→CAT | S96→H99 | GCT→AAT | A99→N102 | | | |
| | AAT→GAA | N97→E100 | *TCA→TCT* | *S174→S177* | | | |
| | AGA→TAC | R98→Y101 | TTG→--- | L175→--- | | | |
| | GCT→AAT | A99→N102 | GTT→--- | V176→--- | | | |
| | AAG→CAA | K125→Q128 | CAA→GCT | Q178→A179 | | | |
| | AAG→CAA | K173→Q176 | GAT→CCA | D179→P180 | | | |
| | *TCA→TCT* | *S174→S177* | GTT→TTG | V181→L182 | | | |
| | TTG→--- | L175→--- | ACT→AAG | T182→K183 | | | |
| | GTA→--- | V176→--- | CCA→TCA | P183→S184 | | | |
| | CAG→GCT | Q178→A179 | AGA→CCT | R184→P185 | | | |
| | GAT→CCA | D179→P180 | AGA→TCA | R212→S213 | | | |
| | GTA→TTG | V181→L182 | *ATT→ATC* | *I213→I214* | | | |
| | ACC→AAG | T182→K183 | GAT→TAT | D214→Y215 | | | |
| | CCT→TCA | P183→S184 | TCT→GAC | S215→D216 | | | |
| | AAG→CCT | K184→P185 | ACT→AAG | T216→K217 | | | |
| | TTT→ATT | F209→I210 | TCT→--- | S217-- | | | |
| | ATG→TCA | M212→S213 | GAT→GAA | D218E | | | |
| | AAT→TAT | N214→Y215 | GAT→CAA | D219Q | | | |
| | TCA→GAC | S215→D216 | TTG→TCG | L220S | | | |
| | ACA→AAG | T216→K217 | GTT→AAG | V221K | | | |
| | AGT→--- | S217→--- | *GGT→GGG* | *G276G* | | | |
| | GAT→GAA | D218E | CCA→TCA | P281S | | | |
| | CAT→CAA | H219Q | TTG→TGC | L313C | | | |
| | TTA→TCG | L220S | TCT→ACG | S314T | | | |
| | TAC→AAG | Y221K | TTG→ATG | L315M | | | |
| | GAG→GAT | E238D | ACC→AGT | T317S | | | |
| | AAA→CAA | K252Q | ATT→ACT | I325T | | | |
| | CCT→TCA | P281S | *GAC→GAT* | *D329D* | | | |
| | CAA→AAA | Q292K | AAG→CGA | K336R | | | |
| | CTC→TGC | L313C | TTA→ATT | L337I | | | |
| | AGC→ACG | S314T | GGT→CGG | G357R | | | |
| | CTC→ATG | L315M | *GGT→GGA* | *G414G* | | | |
| | ACT→AGT | T317S | GAG→GAT | E484D | | | |
| | CAA→GCT | Q321A | | | | | |
| | ATT→ACT | I325T | | | | | |
| | GAA→GAT | E333D | | | | | |
| | AAA→CGA | K336R | | | | | |
| | TTG→ATT | L337I | | | | | |
| | GCT→ACA | A345T | | | | | |
| | GGA→CGG | G357R | | | | | |
| | AAT→ATT | N369I | | | | | |

TABLE 31-continued

CVS Variants

| Mutant | Nucleotide changes vs. wildtype | Amino acid changes vs. wildtype | Nucleotide changes vs. CVS V19 | Amino acid changes vs. CVS V19 | SEQ ID NO nt | SEQ ID NO aa | Valencene production % vs. V19 (Shake Flask) |
|---|---|---|---|---|---|---|---|
| | TCT→TAC | S377Y | | | | | |
| | ACA→AGA | T405R | | | | | |
| | *GGC→GGA* | *G414G* | | | | | |
| | AAT→GGT | N429G | | | | | |
| | GCA→TCT | A436S | | | | | |
| | GAA→GAT | E484D | | | | | |
| | ACC→CCA | T501P | | | | | |
| | GAT→GAA | D536E | | | | | |
| V245 | AGA→AAA | R19K | AGA→AAA | R19K | 779 | 836 | 81.30 |
| | AAA→CAA | K24Q | ACT→TTA | T53L | | | |
| | CAA→AAT | Q38N | GAT→GCA | D54A | | | |
| | ACA→TTA | T53L | GCA→ACC | A55T | | | |
| | GAT→GCA | D54A | GAA→GGA | E56G | | | |
| | GCT→ACC | A55T | GAT→AGG | D57R | | | |
| | GAA→GGA | E56G | CAA→AAA | Q58K | | | |
| | GAT→AGG | D57R | GCT→ATG | A85M | | | |
| | *AAG→AAA* | *K58K* | ATT→TTG | I86L | | | |
| | GTT→ATT | V60I | CAA→GAT | Q87D | | | |
| | GCA→ATG | A85M | CAA→CAC | Q88H | | | |
| | ATA→TTG | I86L | TTG→ATT | L89I | | | |
| | CAA→GAT | Q87D | TGT→TAC | C90Y | | | |
| | AAA→CAC | K88H | ---→AGA | --→R91 | | | |
| | TTA→ATT | L89I | ---→GCT | --→A92 | | | |
| | TGT→TAC | C90Y | ---→GAT | --→D93 | | | |
| | ---→AGA | ---→R91 | *CCA→CCT* | *P91→P94* | | | |
| | ---→GCT | ---→A92 | ATT→TAT | I92→Y95 | | | |
| | ---→GAT | ---→D93 | CAT→TTT | H93→F96 | | | |
| | CCA→CCT | *P91→P94* | ATT→GAG | I94→E97 | | | |
| | ATC→TAT | I92→Y95 | GAT→GCT | D95→A98 | | | |
| | TAT→TTT | Y93→F96 | TCT→CAT | S96→H99 | | | |
| | ATT→GAG | I94→E97 | GAT→GAA | D97→E100 | | | |
| | GAC→GCT | D95→A98 | AAA→TAC | K98→Y101 | | | |
| | AGT→CAT | S96→H99 | GCT→AAT | A99→N102 | | | |
| | AAT→GAA | N97→E100 | *TCA→TCT* | *S174→S177* | | | |
| | AGA→TAC | R98→Y101 | TTG→--- | L175→--- | | | |
| | GCT→AAT | A99→N102 | GTT→--- | V176→--- | | | |
| | AAG→CAA | K125→Q128 | CAA→GCT | Q178→A179 | | | |
| | AAG→CAA | K173→Q176 | GAT→CCA | D179→P180 | | | |
| | *TCA→TCT* | *S174→S177* | GTT→TTG | V181→L182 | | | |
| | TTG→--- | L175→--- | ACT→AAG | T182→K183 | | | |
| | GTA→--- | V176→--- | CCA→TCA | P183→S184 | | | |
| | CAG→GCT | Q178→A179 | AGA→CCT | R184→P185 | | | |
| | GAT→CCA | D179→P180 | AGA→GTC | R212→V213 | | | |
| | GTA→TTG | V181→L182 | ATT→TAC | I213→Y214 | | | |
| | ACC→AAG | T182→K183 | GAT→--- | D214→-- | | | |
| | CCT→TCA | P183→S184 | TCT→--- | S215→-- | | | |
| | AAG→CCT | K184→P185 | ACT→CAA | T216→Q215 | | | |
| | TTT→ATT | F209→I210 | TCT→GAT | S217→D216 | | | |
| | ATG→GTC | M212→V213 | GAT→GAA | D218→E217 | | | |
| | ATC→TAC | I213→Y214 | GAT→GCT | D219→A218 | | | |
| | AAT→--- | N214→--- | TTG→TTC | L220→F219 | | | |
| | TCA→--- | S215→--- | GTT→CAT | V221→H220 | | | |
| | ACA→CAA | T216→Q215 | *GGT→GGG* | *G276→G275* | | | |
| | AGT→GAT | S217→D216 | CCA→TCA | P281→S280 | | | |
| | GAT→GAA | D218→E217 | TTG→TGC | L313→C312 | | | |
| | CAT→GCT | H219→A218 | TCT→ACG | S314→T313 | | | |
| | TTA→TTC | L220→F219 | TTG→ATG | L315→M314 | | | |
| | TAC→CAT | Y221→H220 | ACC→AGT | T317→S316 | | | |
| | GAG→GAT | E238→D237 | *GAC→GAT* | *D329→D328* | | | |
| | AAA→CAA | K252→Q251 | AAG→CGA | K336→R335 | | | |
| | CCT→TCA | P281→S280 | TTA→ATT | L337→1336 | | | |
| | CAA→AAA | Q292→K291 | GGT→CGG | G357→R356 | | | |
| | CTC→TGC | L313→C312 | GAG→GAT | E484→D483 | | | |
| | AGC→ACG | S314→T313 | | | | | |
| | CTC→ATG | L315→M314 | | | | | |
| | ACT→AGT | T317→S316 | | | | | |
| | CAA→GCT | Q321→A320 | | | | | |
| | GAA→GAT | E333→D332 | | | | | |
| | AAA→CGA | K336→R335 | | | | | |
| | TTG→ATT | L337→I336 | | | | | |

TABLE 31-continued

CVS Variants

| Mutant | Nucleotide changes vs. wildtype | Amino acid changes vs. wildtype | Nucleotide changes vs. CVS V19 | Amino acid changes vs. CVS V19 | SEQ ID NO nt | SEQ ID NO aa | Valencene production % vs. V19 (Shake Flask) |
|---|---|---|---|---|---|---|---|
| | GCT→ACA | A345→T344 | | | | | |
| | GGA→CGG | G357→R356 | | | | | |
| | AAT→ATT | N369→I368 | | | | | |
| | TCT→TAC | S377→Y376 | | | | | |
| | ACA→AGA | T405→R404 | | | | | |
| | AAT→GGT | N429→G428 | | | | | |
| | GCA→TCT | A436→S435 | | | | | |
| | GAA→GAT | E484→D483 | | | | | |
| | ACC→CCA | T501→P500 | | | | | |
| | GAT→GAA | D536→E535 | | | | | |
| V255 | AGA→AAA | R19K | AGA→AAA | R19K | 789 | 846 | ND |
| | AAA→CAA | K24Q | ACT→TTA | T53L | | | |
| | CAA→AAT | Q38N | GAT→GCA | D54A | | | |
| | ACA→TTA | T53L | GCA→ACC | A55T | | | |
| | GAT→GCA | D54A | GAA→GGA | E56G | | | |
| | GCT→ACC | A55T | GAT→AGG | D57R | | | |
| | GAA→GGA | E56G | CAA→AAA | Q58K | | | |
| | GAT→AGG | D57R | GCT→ATG | A85M | | | |
| | *AAG→AAA* | *K58K* | ATT→TTG | I86L | | | |
| | GTT→ATT | V60I | CAA→GAT | Q87D | | | |
| | GCA→ATG | A85M | CAA→CAC | Q88H | | | |
| | ATA→TTG | I86L | TTG→ATT | L89I | | | |
| | CAA→GAT | Q87D | TGT→TAC | C90Y | | | |
| | AAA→CAC | K88H | ---→AGA | ---→R91 | | | |
| | TTA→ATT | L89I | ---→GCT | ---→A92 | | | |
| | TGT→TAC | C90Y | ---→GAT | ---→D93 | | | |
| | ---→AGA | ---→R91 | *CCA→CCT* | *P91→P94* | | | |
| | ---→GCT | ---→A92 | ATT→TAT | I92→Y95 | | | |
| | ---→GAT | ---→D93 | CAT→TTT | H93→F96 | | | |
| | *CCA→CCT* | *P91→P94* | ATT→GAG | I94→E97 | | | |
| | ATC→TAT | I92→Y95 | GAT→GCT | D95→A98 | | | |
| | TAT→TTT | Y93→F96 | TCT→CAT | S96→H99 | | | |
| | ATT→GAG | I94→E97 | GAT→GAA | D97→E100 | | | |
| | GAC→GCT | D95→A98 | AAA→TAC | K98→Y101 | | | |
| | AGT→CAT | S96→H99 | GCT→AAT | A99→N102 | | | |
| | AAT→GAA | N97→E100 | *TCA→TCT* | *S174→S177* | | | |
| | AGA→TAC | R98→Y101 | TTG→--- | L175→--- | | | |
| | GCT→AAT | A99→N102 | GTT→--- | V176→--- | | | |
| | AAG→CAA | K125→Q128 | CAA→GCT | Q178→A179 | | | |
| | AAG→CAA | K173→Q176 | GAT→CCA | D179→P180 | | | |
| | *TCA→TCT* | *S174→S177* | GTT→TTG | V181→L182 | | | |
| | TTG→--- | L175→--- | ACT→AAG | T182→K183 | | | |
| | GTA→--- | V176→--- | CCA→TCA | P183→S184 | | | |
| | CAG→GCT | Q178→A179 | AGA→CCT | R184 →P185 | | | |
| | GAT→CCA | D179→P180 | AGA→GTC | R212→V213 | | | |
| | GTA→TTG | V181→L182 | ATT→TAC | I213→Y214 | | | |
| | ACC→AAG | T182→K183 | GAT→--- | D214→-- | | | |
| | CCT→TCA | P183→S184 | TCT→--- | S215→-- | | | |
| | AAG→CCT | K184→P185 | ACT→CAA | T216→Q215 | | | |
| | TTT→ATT | F209→I210 | TCT→GAT | S217→D216 | | | |
| | ATG→GTC | M212→V213 | GAT→GAA | D218→E217 | | | |
| | ATC→TAC | I213→Y214 | GAT→GCT | D219→A218 | | | |
| | AAT→--- | N214→-- | TTG→TTC | L220→F219 | | | |
| | TCA→--- | S215→-- | GTT→CAT | V221→H220 | | | |
| | ACA→CAA | T216→Q215 | *GGT→GGG* | *G276→G275* | | | |
| | AGT→GAT | S217→D216 | CCA→TCA | P281→S280 | | | |
| | GAT→GAA | D218→E217 | TTG→TGC | L313→C312 | | | |
| | CAT→GCT | H219→A218 | TCT→ACG | S314→T313 | | | |
| | TTA→TTC | L220→F219 | TTG→ATG | L315→M314 | | | |
| | TAC→CAT | Y221→H220 | ACC→AGT | T317→S316 | | | |
| | GAG→GAT | E238→D237 | *GAC→GAT* | *D329→D328* | | | |
| | AAA→CAA | K252→Q251 | AAG→CGA | K336→R335 | | | |
| | CCT→TCA | P281→S280 | TTA→ATT | L337→I336 | | | |
| | CAA→AAA | Q292→K291 | GGT→CGG | G357→R356 | | | |
| | CTC→TGC | L313→C312 | CAA→CTA | Q448→L447 | | | |
| | AGC→ACG | S314→T313 | GAG→GAT | E484→D483 | | | |
| | CTC→ATG | L315→M314 | | | | | |
| | ACT→AGT | T317→S316 | | | | | |
| | CAA→GCT | Q321→A320 | | | | | |
| | GAA→GAT | E333→D332 | | | | | |

TABLE 31-continued

CVS Variants

| Mutant | Nucleotide changes vs. wildtype | Amino acid changes vs. wildtype | Nucleotide changes vs. CVS V19 | Amino acid changes vs. CVS V19 | SEQ ID NO nt | SEQ ID NO aa | Valencene production % vs. V19 (Shake Flask) |
|---|---|---|---|---|---|---|---|
| | AAA→CGA | K336→R335 | | | | | |
| | TTG→ATT | L337→I336 | | | | | |
| | GCT→ACA | A345→T344 | | | | | |
| | GGA→CGG | G357→R356 | | | | | |
| | AAT→ATT | N369→I368 | | | | | |
| | TCT→TAC | S377→Y376 | | | | | |
| | ACA→AGA | T405→R404 | | | | | |
| | AAT→GGT | N429→G428 | | | | | |
| | GCA→TCT | A436→S435 | | | | | |
| | CAA→CTA | Q448→L447 | | | | | |
| | GAA→GAT | E484→D483 | | | | | |
| | ACC→CCA | T501→P500 | | | | | |
| | GAT→GAA | D536→E535 | | | | | |

f. V246, V247, V248, V249, V250, V251, V252, V253, V254 and V272

In CVS variants V246, V247, V248, V249, V250, V251, V252, V253, V254 and V272, amino acids 53-58 were replaced by amino acids 58-63 of TEAS (SEQ ID NO:941), amino acids 85-99 were replaced by amino acids 93-110 of HPS (SEQ ID NO:942) and amino acids 174-184 were replaced by amino acids 185-193 of HPS (SEQ ID NO:942) or 177-185 of TEAS (SEQ ID NO:941) as described above. In addition, amino acids 212-222 were replaced by random amino acids.

CVS variants V246, V247, V248, V249, V250, V253 and V254 were generated as described in Example 4C.d., using V240 and V19 as templates for the two PCR reactions with oligos set forth in Table 25 above. For example, V246 was produced using random mutagenic oligos 21-140.1 and 21-140.2 with outer oligos 11-154.3 and 11-154.4 to modify amino acid positions 212 to 221. The PCR reaction with 11-154.3 and 21-140.2 used V240 as template, but the second reaction used V19 as template. CVS variants V251 and V252 were generated as described in Example 4.C.a., using V241 and V19 as templates for the two PCR reactions. V272 was generated as in Example 4C.d., with the exception that V240 was used as template in both PCR reactions.

The variants, including amino acid and nucleotide changes versus both wildtype CVS and CVS V19, and valencene production % versus CVS V19 are set forth in Table 32 below. Several additional isolates were identified that produce approximately 77% of the valencene titer of CVS V19, but additionally produce high amounts of b-elemene.

TABLE 32

CVS Variants

| Mutant | Nucleotide changes vs. wildtype | Amino acid changes vs. wildtype | Nucleotide changes vs. CVS V19 | Amino acid changes vs. CVS V19 | SEQ ID NO nt | SEQ ID NO aa | Valencene production % vs. V19 (Shake Flask) |
|---|---|---|---|---|---|---|---|
| V246 | AGA→AAA | R19K | AGA→AAA | R19K | 780 | 837 | 103.86 |
| | AAA→CAA | K24Q | ACT→TTA | T53L | | | |
| | CAA→AAT | Q38N | GAT→GCA | D54A | | | |
| | ACA→TTA | T53L | GCA→ACC | A55T | | | |
| | GAT→GCA | D54A | GAA→GGA | E56G | | | |
| | GCT→ACC | A55T | GAT→AGG | D57R | | | |
| | GAA→GGA | E56G | CAA→AAA | Q58K | | | |
| | GAT→AGG | D57R | GCT→ATG | A85M | | | |
| | *AAG→AAA* | *K58K* | ATT→TTG | I86L | | | |
| | GTT→ATT | V60I | CAA→GAT | Q87D | | | |
| | GCA→ATG | A85M | CAA→CAC | Q88H | | | |
| | ATA→TTG | I86L | TTG→ATT | L89I | | | |
| | CAA→GAT | Q87D | TGT→TAC | C90Y | | | |
| | AAA→CAC | K88H | ---→AGA | ---→R91 | | | |
| | TTA→ATT | L89I | ---→GCT | ---→A92 | | | |
| | TGT→TAC | C90Y | ---→GAT | ---→D93 | | | |
| | ---→AGA | ---→R91 | *CCA→CCT* | *P91→P94* | | | |
| | ---→GCT | ---→A92 | ATT→TAT | I92→Y95 | | | |
| | ---→GAT | ---→D93 | CAT→TTT | H93→F96 | | | |
| | *CCA→CCT* | *P91→P94* | ATT→GAG | I94→E97 | | | |
| | ATC→TAT | I92→Y95 | GAT→GCT | D95→A98 | | | |
| | TAT→TTT | Y93→F96 | TCT→CAT | S96→H99 | | | |
| | ATT→GAG | I94→E97 | GAT→GAA | D97→E100 | | | |
| | GAC→GCT | D95→A98 | AAA→TAC | K98→Y101 | | | |

TABLE 32-continued

CVS Variants

| Mutant | Nucleotide changes vs. wildtype | Amino acid changes vs. wildtype | Nucleotide changes vs. CVS V19 | Amino acid changes vs. CVS V19 | SEQ ID NO nt | SEQ ID NO aa | Valencene production % vs. V19 (Shake Flask) |
|---|---|---|---|---|---|---|---|
| | AGT→CAT | S96→H99 | GCT→AAT | A99→N102 | | | |
| | AAT→GAA | N97→E100 | *TCA→TCT* | *S174→S177* | | | |
| | AGA→TAC | R98→Y101 | TTG→--- | L175→-- | | | |
| | GCT→AAT | A99→N102 | GTT→--- | V176→-- | | | |
| | AAG→CAA | K125→Q128 | CAA→GCT | Q178→A179 | | | |
| | AAG→CAA | K173→Q176 | GAT→CCA | D179→P180 | | | |
| | *TCA→TCT* | *S174→S177* | GTT→TTG | V181→L182 | | | |
| | TTG→--- | L175→--- | ACT→AAG | T182→K183 | | | |
| | GTA→--- | V176→--- | CCA→TCA | P183→S184 | | | |
| | CAG→GCT | Q178→A179 | AGA→CCT | R184→P185 | | | |
| | GAT→CCA | D179→P180 | *AGA→AGG* | *R195→R196* | | | |
| | GTA→TTG | V181→L182 | AGA→TAT | R212→Y213 | | | |
| | ACC→AAG | T182→K183 | ATT→TCA | I213→S214 | | | |
| | CCT→TCA | P183→S184 | GAT→CCT | D214→P215 | | | |
| | AAG→CCT | K184→P185 | TCT→AAC | S215→N216 | | | |
| | *CGT→AGG* | *R195→R196* | ACT→GTT | T216→V217 | | | |
| | TTT→ATT | F209→I210 | TCT→ATC | S217→I218 | | | |
| | ATG→TAT | M212→Y213 | *GAT→GAC* | *D218→D219* | | | |
| | ATC→TCA | I213→S214 | GAT→CTA | D219→L220 | | | |
| | AAT→CCT | N214→P215 | TTG→GCT | L220→A221 | | | |
| | TCA→AAC | S215→N216 | GTT→CCA | V221→P222 | | | |
| | ACA→GTT | T216→V217 | | | | | |
| | AGT→ATC | S217→I218 | | | | | |
| | *GAT→GAC* | *D218→D219* | | | | | |
| | CAT→CTA | H219→L220 | | | | | |
| | TTA→GCT | L220→A221 | | | | | |
| | TAC→CCA | Y221→P222 | | | | | |
| | GAG→GAT | E238→D239 | | | | | |
| | AAA→CAA | K252→Q253 | | | | | |
| | CAA→AAA | Q292→K293 | | | | | |
| | CAA→GCT | Q321→A322 | | | | | |
| | GAA→GAT | E333→D334 | | | | | |
| | GCT→ACA | A345→T346 | | | | | |
| | AAT→ATT | N369→I370 | | | | | |
| | TCT→TAC | S377→Y378 | | | | | |
| | ACA→AGA | T405→R406 | | | | | |
| | AAT→GGT | N429→G430 | | | | | |
| | GCA→TCT | A436→S437 | | | | | |
| | ACC→CCA | T501→P502 | | | | | |
| | GAT→GAA | D536→E537 | | | | | |
| V247 | AGA→AAA | R19K | AGA→AAA | R19K | 781 | 838 | 101.59 |
| | AAA→CAA | K24Q | ACT→TTA | T53L | | | |
| | CAA→AAT | Q38N | GAT→GCA | D54A | | | |
| | ACA→TTA | T53L | GCA→ACC | A55T | | | |
| | GAT→GCA | D54A | GAA→GGA | E56G | | | |
| | GCT→ACC | A55T | GAT→AGG | D57R | | | |
| | GAA→GGA | E56G | CAA→AAA | Q58K | | | |
| | GAT→AGG | D57R | GCT→ATG | A85M | | | |
| | *AAG→AAA* | *K58K* | ATT→TTG | I86L | | | |
| | GTT→ATT | V60I | CAA→GAT | Q87D | | | |
| | GCA→ATG | A85M | CAA→CAC | Q88H | | | |
| | ATA→TTG | I86L | TTG→ATT | L89I | | | |
| | CAA→GAT | Q87D | TGT→TAC | C90Y | | | |
| | AAA→CAC | K88H | ---→AGA | ---→R91 | | | |
| | TTA→ATT | L89I | ---→GCT | ---→A92 | | | |
| | TGT→TAC | C90Y | ---→GAT | ---→D93 | | | |
| | ---→AGA | ---→R91 | *CCA→CCT* | *P91→P94* | | | |
| | ---→GCT | ---→A92 | ATT→TAT | I92→Y95 | | | |
| | ---→GAT | ---→D93 | CAT→TTT | H93→F96 | | | |
| | *CCA→CCT* | *P91→P94* | ATT→GAG | I94→E97 | | | |
| | ATC→TAT | I92→Y95 | GAT→GCT | D95→A98 | | | |
| | TAT→TTT | Y93→F96 | TCT→CAT | S96→H99 | | | |
| | ATT→GAG | I94→E97 | GAT→GAA | D97→E100 | | | |
| | GAC→GCT | D95→A98 | AAA→TAC | K98→Y101 | | | |
| | AGT→CAT | S96→H99 | GCT→AAT | A99→N102 | | | |
| | AAT→GAA | N97→E100 | *TCA→TCT* | *S174→S177* | | | |
| | AGA→TAC | R98→Y101 | TTG→--- | L175→--- | | | |
| | GCT→AAT | A99→N102 | GTT→--- | V176→--- | | | |
| | AAG→CAA | K125→Q128 | CAA→GCT | Q178→A179 | | | |
| | AAG→CAA | K173→Q176 | GAT→CCA | D179→P180 | | | |

TABLE 32-continued

CVS Variants

| Mutant | Nucleotide changes vs. wildtype | Amino acid changes vs. wildtype | Nucleotide changes vs. CVS V19 | Amino acid changes vs. CVS V19 | SEQ ID NO nt | SEQ ID NO aa | Valencene production % vs. V19 (Shake Flask) |
|---|---|---|---|---|---|---|---|
| | *TCA→TCT* | *S174→S177* | GTT→TTG | V181→L182 | | | |
| | TTG→--- | L175→--- | ACT→AAG | T182→K183 | | | |
| | GTA→--- | V176→--- | CCA→TCA | P183→S184 | | | |
| | CAG→GCT | Q178→A179 | AGA→CCT | R184→P185 | | | |
| | GAT→CCA | D179→P180 | AGA→AAG | R212→K213 | | | |
| | GTA→TTG | V181→L182 | ATT→CCT | I213→P214 | | | |
| | ACC→AAG | T182→K183 | GAT→GTG | D214→V215 | | | |
| | CCT→TCA | P183→S184 | TCT→ACG | S215→T216 | | | |
| | AAG→CCT | K184→P185 | ACT→CGC | T216→R217 | | | |
| | TTT→ATT | F209→I210 | *TCT→AGC* | *S217→S218* | | | |
| | ATG→AAG | M212→K213 | GAT→CTA | D218→L219 | | | |
| | ATC→CCT | I213→P214 | GAT→TCG | D219→S220 | | | |
| | AAT→GTG | N214→V215 | TTG→GCA | L220→A221 | | | |
| | TCA→ACG | S215→T216 | GTT→CTG | V221→L222 | | | |
| | ACA→CGC | T216→R217 | GTT→GCT | V320→A321 | | | |
| | *AGT→AGC* | *S217→S218* | | | | | |
| | GAT→CTA | D218→L219 | | | | | |
| | CAT→TCG | H219→S220 | | | | | |
| | TTA→GCA | L220→A221 | | | | | |
| | TAC→CTG | Y221→L222 | | | | | |
| | GAG→GAT | E238→D239 | | | | | |
| | AAA→CAA | K252→Q253 | | | | | |
| | CAA→AAA | Q292→K293 | | | | | |
| | GTT→GCT | V320→A321 | | | | | |
| | CAA→GCT | Q321→A322 | | | | | |
| | GAA→GAT | E333→D334 | | | | | |
| | GCT→ACA | A345→T346 | | | | | |
| | AAT→ATT | N369→I370 | | | | | |
| | TCT→TAC | S377→Y378 | | | | | |
| | ACA→AGA | T405→R406 | | | | | |
| | AAT→GGT | N429→G430 | | | | | |
| | GCA→TCT | A436→S437 | | | | | |
| | ACC→CCA | T501→P502 | | | | | |
| | GAT→GAA | D536→E537 | | | | | |
| V248 | AGA→AAA | R19K | AGA→AAA | R19K | 782 | 839 | 94.32 |
| | AAA→CAA | K24Q | ACT→TTA | T53L | | | |
| | CAA→AAT | Q38N | GAT→GCA | D54A | | | |
| | ACA→TTA | T53L | GCA→ACC | A55T | | | |
| | GAT→GCA | D54A | GAA→GGA | E56G | | | |
| | GCT→ACC | A55T | GAT→AGG | D57R | | | |
| | GAA→GGA | E56G | CAA→AAA | Q58K | | | |
| | GAT→AGG | D57R | GCT→ATG | A85M | | | |
| | *AAG→AAA* | *K58K* | ATT→TTG | I86L | | | |
| | GTT→ATT | V60I | CAA→GAT | Q87D | | | |
| | GCA→ATG | A85M | CAA→CAC | Q88H | | | |
| | ATA→TTG | I86L | TTG→ATT | L89I | | | |
| | CAA→GAT | Q87D | TGT→TAC | C90Y | | | |
| | AAA→CAC | K88H | ---→AGA | ---→R91 | | | |
| | TTA→ATT | L89I | ---→GCT | ---→A92 | | | |
| | TGT→TAC | C90Y | ---→GAT | ---→D93 | | | |
| | ---→AGA | ---→R91 | *CCA→CCT* | *P91→P94* | | | |
| | ---→GCT | ---→A92 | ATT→TAT | I92→Y95 | | | |
| | ---→GAT | ---→D93 | CAT→TTT | H93→F96 | | | |
| | *CCA→CCT* | *P91→P94* | ATT→GAG | I94→E97 | | | |
| | ATC→TAT | I92→Y95 | GAT→GCT | D95→A98 | | | |
| | TAT→TTT | Y93→F96 | TCT→CAT | S96→H99 | | | |
| | ATT→GAG | I94→E97 | GAT→GAA | D97→E100 | | | |
| | GAC→GCT | D95→A98 | AAA→TAC | K98→Y101 | | | |
| | AGT→CAT | S96→H99 | GCT→AAT | A99→N102 | | | |
| | AAT→GAA | N97→E100 | *TCA→TCT* | *S174→S177* | | | |
| | AGA→TAC | R98→Y101 | TTG→--- | L175→--- | | | |
| | GCT→AAT | A99→N102 | GTT→--- | V176→--- | | | |
| | AAG→CAA | K125→Q128 | CAA→GCT | Q178→A179 | | | |
| | AAG→CAA | K173→Q176 | GAT→CCA | D179→P180 | | | |
| | *TCA→TCT* | *S174→S177* | GTT→TTG | V181→L182 | | | |
| | TTG→--- | L175→--- | ACT→AAG | T182→K183 | | | |
| | GTA→--- | V176→--- | CCA→TCA | P183→S184 | | | |
| | CAG→GCT | Q178→A179 | AGA→CCT | R184→P185 | | | |
| | GAT→CCA | D179→P180 | AGA→ATG | R212→M213 | | | |
| | GTA→TTG | V181→L182 | ATT→CAG | I213→Q214 | | | |

TABLE 32-continued

CVS Variants

| Mutant | Nucleotide changes vs. wildtype | Amino acid changes vs. wildtype | Nucleotide changes vs. CVS V19 | Amino acid changes vs. CVS V19 | SEQ ID NO nt | SEQ ID NO aa | Valencene production % vs. V19 (Shake Flask) |
|---|---|---|---|---|---|---|---|
| | ACC→AAG | T182→K183 | GAT→CAC | D214→H215 | | | |
| | CCT→TCA | P183→S184 | TCT→TTA | S215→L216 | | | |
| | AAG→CCT | K184→P185 | ACT→TGT | T216→C217 | | | |
| | TTT→ATT | F209→I210 | TCT→TTC | S217→F218 | | | |
| | ATC→CAG | I213→Q214 | GAT→TCC | D218→S219 | | | |
| | AAT→CAC | N214→H215 | GAT→CGT | D219→R220 | | | |
| | TCA→TTA | S215→L216 | TTG→CAT | L220→H221 | | | |
| | ACA→TGT | T216→C217 | GTT→AAA | V221→K222 | | | |
| | AGT→TTC | S217→F218 | *AAA→AAG* | *K499→K500* | | | |
| | GAT→TCC | D218→S219 | | | | | |
| | CAT→CGT | H219→R220 | | | | | |
| | TTA→CAT | L220→H221 | | | | | |
| | TAC→AAA | Y221→K222 | | | | | |
| | GAG→GAT | E238→D239 | | | | | |
| | AAA→CAA | K252→Q253 | | | | | |
| | CAA→AAA | Q292→K293 | | | | | |
| | CAA→GCT | Q321→A322 | | | | | |
| | GAA→GAT | E333→D334 | | | | | |
| | GCT→ACA | A345→T346 | | | | | |
| | AAT→ATT | N369→I370 | | | | | |
| | TCT→TAC | S377→Y378 | | | | | |
| | ACA→AGA | T405→R406 | | | | | |
| | AAT→GGT | N429→G430 | | | | | |
| | GCA→TCT | A436→S437 | | | | | |
| | ACC→CCA | T501→P502 | | | | | |
| | GAT→GAA | D536→E537 | | | | | |
| V249 | AGA→AAA | R19K | AGA→AAA | R19K | 783 | 840 | 100.75 |
| | AAA→CAA | K24Q | *GAA→GAG* | *E42E* | | | |
| | CAA→AAT | Q38N | ACT→TTA | T53L | | | |
| | ACA→TTA | T53L | GAT→GCA | D54A | | | |
| | GAT→GCA | D54A | GCA→ACC | A55T | | | |
| | GCT→ACC | A55T | GAA→GGA | E56G | | | |
| | GAA→GGA | E56G | GAT→AGG | D57R | | | |
| | GAT→AGG | D57R | CAA→AAA | Q58K | | | |
| | *AAG→AAA* | *K58K* | GCT→ATG | A85M | | | |
| | GTT→ATT | V60I | ATT→TTG | I86L | | | |
| | GCA→ATG | A85M | CAA→GAT | Q87D | | | |
| | ATA→TTG | I86L | CAA→CAC | Q88H | | | |
| | CAA→GAT | Q87D | TTG→ATT | L89I | | | |
| | AAA→CAC | K88H | TGT→TAC | C90Y | | | |
| | TTA→ATT | L89I | ---→AGA | ---→R91 | | | |
| | TGT→TAC | C90Y | ---→GCT | ---→A92 | | | |
| | ---→AGA | ---→R91 | ---→GAT | ---→D93 | | | |
| | ---→GCT | ---→A92 | *CCA→CCT* | *P91→P94* | | | |
| | ---→GAT | ---→D93 | ATT→TAT | I92→Y95 | | | |
| | *CCA→CCT* | *P91→P94* | CAT→TTT | H93→F96 | | | |
| | ATC→TAT | I92→Y95 | ATT→GAG | I94→E97 | | | |
| | TAT→TTT | Y93→F96 | GAT→GCT | D95→A98 | | | |
| | ATT→GAG | I94→E97 | TCT→CAT | S96→H99 | | | |
| | GAC→GCT | D95→A98 | GAT→GAA | D97→E100 | | | |
| | AGT→CAT | S96→H99 | AAA→TAC | K98→Y101 | | | |
| | AAT→GAA | N97→E100 | GCT→AAT | A99→N102 | | | |
| | AGA→TAC | R98→Y101 | *TCA→TCT* | *S174→S177* | | | |
| | GCT→AAT | A99→N102 | TTG→--- | L175→--- | | | |
| | AAG→CAA | K125→Q128 | GTT→--- | V176→--- | | | |
| | AAG→CAA | K173→Q176 | CAA→GCT | Q178→A179 | | | |
| | *TCA→TCT* | *S174→S177* | GAT→CCA | D179→P180 | | | |
| | TTG→--- | L175→--- | GTT→TTG | V181→L182 | | | |
| | GTA→--- | V176→--- | ACT→AAG | T182→K183 | | | |
| | CAG→GCT | Q178→A179 | CCA→TCA | P183→S184 | | | |
| | GAT→CCA | D179→P180 | AGA→CCT | R184→P185 | | | |
| | GTA→TTG | V181→L182 | AGA→TTT | R212→F213 | | | |
| | ACC→AAG | T182→K183 | ATT→AAT | I213→N214 | | | |
| | CCT→TCA | P183→S184 | GAT→TGT | D214→C215 | | | |
| | AAG→CCT | K184→P185 | TCT→GAT | S215→V216 | | | |
| | TTT→ATT | F209→I210 | ACT→AAA | T216→K217 | | | |
| | ATG→TTT | M212→F213 | TCT→TAC | S217→Y218 | | | |
| | ATC→AAT | I213→N214 | GAT→GCC | D218→A219 | | | |
| | AAT→TGT | N214→C215 | GAT→TTC | D219→F220 | | | |
| | TCA→GTA | S215→V216 | TTG→AAC | L220→T221 | | | |

TABLE 32-continued

CVS Variants

| Mutant | Nucleotide changes vs. wildtype | Amino acid changes vs. wildtype | Nucleotide changes vs. CVS V19 | Amino acid changes vs. CVS V19 | SEQ ID NO nt | SEQ ID NO aa | Valencene production % vs. V19 (Shake Flask) |
|---|---|---|---|---|---|---|---|
| | ACA→AAA | T216→K217 | GTT→CAG | V221→Q222 | | | |
| | AGT→TAC | S217→Y218 | | | | | |
| | GAT→GCC | D218→A219 | | | | | |
| | CAT→TTC | H219→F220 | | | | | |
| | TTA→ACC | L220→T221 | | | | | |
| | TCA→CAG | Y221→Q222 | | | | | |
| | GAG→GAT | E238→D239 | | | | | |
| | AAA→CAA | K252→Q253 | | | | | |
| | CAA→AAA | Q292→K293 | | | | | |
| | CAA→GCT | Q321→A322 | | | | | |
| | GAA→GAT | E333→D334 | | | | | |
| | GCT→ACA | A345→T346 | | | | | |
| | AAT→ATT | N369→I370 | | | | | |
| | TCT→TAC | S377→Y378 | | | | | |
| | ACA→AGA | T405→R406 | | | | | |
| | AAT→GGT | N429→G430 | | | | | |
| | GCA→TCT | A436→S437 | | | | | |
| | ACC→CCA | T501→P502 | | | | | |
| | GAT→GAA | D536→E537 | | | | | |
| V250 | AGA→AAA | R19K | AGA→AAA | R19K | 784 | 841 | 106.46 |
| | AAA→CAA | K24Q | ACT→TTA | T53L | | | |
| | CAA→AAT | Q38N | GAT→GCA | D54A | | | |
| | ACA→TTA | T53L | GCA→ACC | A55T | | | |
| | GAT→GCA | D54A | GAA→GGA | E56G | | | |
| | GCT→ACC | A55T | GAT→AGG | D57R | | | |
| | GAA→GGA | E56G | CAA→AAA | Q58K | | | |
| | GAT→AGG | D57R | GCT→ATG | A85M | | | |
| | *AAG→AAA* | *K58K* | ATT→TTG | I86L | | | |
| | GTT→ATT | V60I | CAA→GAT | Q87D | | | |
| | GCA→ATG | A85M | CAA→CAC | Q88H | | | |
| | ATA→TTG | I86L | TTG→ATT | L89I | | | |
| | CAA→GAT | Q87D | TGT→TAC | C90Y | | | |
| | AAA→CAC | K88H | ---→AGA | ---→R91 | | | |
| | TTA→ATT | L89I | ---→GCT | ---→A92 | | | |
| | TGT→TAC | C90Y | ---→GAT | ---→D93 | | | |
| | ---→AGA | ---→R91 | *CCA→CCT* | *P91→P94* | | | |
| | ---→GCT | ---→A92 | ATT→TAT | I92→Y95 | | | |
| | ---→GAT | ---→D93 | CAT→TTT | H93→F96 | | | |
| | *CCA→CCT* | *P91→P94* | ATT→GAG | I94→E97 | | | |
| | ATC→TAT | I92→Y95 | GAT→GCT | D95→A98 | | | |
| | TAT→TTT | Y93→F96 | TCT→CAT | S96→H99 | | | |
| | ATT→GAG | I94→E97 | GAT→GAA | D97→E100 | | | |
| | GAC→GCT | D95→A98 | AAA→TAC | K98→Y101 | | | |
| | AGT→CAT | S96→H99 | GCT→AAT | A99→N102 | | | |
| | AAT→GAA | N97→E100 | *TCA→TCT* | *S174→S177* | | | |
| | AGA→TAC | R98→Y101 | TTG→--- | L175→--- | | | |
| | GCT→AAT | A99→N102 | GTT→--- | V176→--- | | | |
| | AAG→CAA | K125→Q128 | CAA→GCT | Q178→A179 | | | |
| | AAG→CAA | K173→Q176 | GAT→CCA | D179→P180 | | | |
| | *TCA→TCT* | *S174→S177* | GTT→TTG | V181→L182 | | | |
| | TTG→--- | L175→--- | ACT→AAG | T182→K183 | | | |
| | GTA→--- | V176→--- | CCA→TCA | P183→S184 | | | |
| | CAG→GCT | Q178→A179 | AGA→CCT | R184→P185 | | | |
| | GAT→CCA | D179→P180 | AGA→TAC | R212→Y213 | | | |
| | GTA→TTG | V181→L182 | ATT→CGT | I213→R214 | | | |
| | ACC→AAG | T182→K183 | GAT→CTA | D214→L215 | | | |
| | CCT→TCA | P183→S184 | TCT→AAT | S215→N216 | | | |
| | AAG→CCT | K184→P185 | ACT→GAT | T216→D217 | | | |
| | TTT→ATT | F209→I210 | TCT→AAT | S217→N218 | | | |
| | ATG→TAC | M212→Y213 | GAT→TAC | D218→Y219 | | | |
| | ATC→CGT | I213→R214 | GAT→GCA | D219→A220 | | | |
| | AAT→CTA | N214→L215 | TTG→GAA | L220→E221 | | | |
| | TCA→AAT | S215→N216 | GTT→TGG | V221→W222 | | | |
| | ACA→GAT | T216→D217 | | | | | |
| | AGT→AAT | S217→N218 | | | | | |
| | GAT→TAC | D218→Y219 | | | | | |
| | CAT→GCA | H219→A220 | | | | | |
| | TTA→GAA | L220→E221 | | | | | |
| | TAC→TGG | Y221→W222 | | | | | |
| | GAG→GAT | E238→D239 | | | | | |

TABLE 32-continued

| CVS Variants | | | | | | | |
|---|---|---|---|---|---|---|---|
| Mutant | Nucleotide changes vs. wildtype | Amino acid changes vs. wildtype | Nucleotide changes vs. CVS V19 | Amino acid changes vs. CVS V19 | SEQ ID NO nt | SEQ ID NO aa | Valencene production % vs. V19 (Shake Flask) |
| | AAA→CAA | K252→Q253 | | | | | |
| | CAA→AAA | Q292→K293 | | | | | |
| | CAA→GCT | Q321→A322 | | | | | |
| | GAA→GAT | E333→D334 | | | | | |
| | GCT→ACA | A345→T346 | | | | | |
| | AAT→ATT | N369→I370 | | | | | |
| | TCT→TAC | S377→Y378 | | | | | |
| | ACA→AGA | T405→R406 | | | | | |
| | AAT→GGT | N429→G430 | | | | | |
| | GCA→TCT | A436→S437 | | | | | |
| | ACC→CCA | T501→P502 | | | | | |
| | GAT→GAA | D536→E537 | | | | | |
| V251 | AAA→CAA | K24Q | GAT→GGT | D28G | 785 | 842 | ND |
| | GAT→GGT | D28G | ACT→TTA | T53L | | | |
| | CAA→AAT | Q38N | GAT→GCA | D54A | | | |
| | ACA→TTA | T53L | GCA→ACC | A55T | | | |
| | GAT→GCA | D54A | GAA→GGA | E56G | | | |
| | GCT→ACC | A55T | GAT→AGG | D57R | | | |
| | GAA→GGA | E56G | CAA→AAA | Q58K | | | |
| | GAT→AGG | D57R | AAA→AGA | K62R | | | |
| | *AAG→AAA* | *K58K* | GCT→ATG | A85M | | | |
| | GTT→ATT | V60I | ATT→TTG | I86L | | | |
| | AAG→AGA | K62R | CAA→GAT | Q87D | | | |
| | GCA→ATG | A85M | CAA→CAC | Q88H | | | |
| | ATA→TTG | I86L | TTG→ATT | L89I | | | |
| | CAA→GAT | Q87D | TGT→TAC | C90Y | | | |
| | AAA→CAC | K88H | ---→AGA | ---→R91 | | | |
| | TTA→ATT | L89I | ---→GCT | ---→A92 | | | |
| | TGT→TAC | C90Y | ---→GAT | ---→D93 | | | |
| | ---→AGA | ---→R91 | *CCA→CCT* | *P91→P94* | | | |
| | ---→GCT | ---→A92 | ATT→TAT | I92→Y95 | | | |
| | ---→GAT | ---→D93 | CAT→TTT | H93→F96 | | | |
| | *CCA→CCT* | *P91→P94* | ATT→GAG | I94→E97 | | | |
| | ATC→TAT | I92→Y95 | GAT→GCT | D95→A98 | | | |
| | TAT→TTT | Y93→F96 | TCT→CAT | S96→H99 | | | |
| | ATT→GAG | I94→E97 | GAT→GAA | D97→E100 | | | |
| | GAC→GCT | D95→A98 | AAA→TAC | K98→Y101 | | | |
| | AGT→CAT | S96→H99 | GCT→AAT | A99→N102 | | | |
| | AAT→GAA | N97→E100 | *TCA→TCT* | *S174→S177* | | | |
| | AGA→TAC | R98→Y101 | TTG→--- | L175→--- | | | |
| | GCT→AAT | A99→N102 | GTT→--- | V176→--- | | | |
| | AAG→CAA | K125→Q128 | CAA→GCT | Q178→A179 | | | |
| | AAG→CAA | K173→Q176 | GAT→CCA | D179→P180 | | | |
| | *TCA→TCT* | *S174→S177* | GTT→TTG | V181→L182 | | | |
| | TTG→--- | L175→--- | ACT→AAG | T182→K183 | | | |
| | GTA→--- | V176→--- | CCA→TCA | P183→S184 | | | |
| | CAG→GCT | Q178→A179 | AGA→CCT | R184→P185 | | | |
| | GAT→CCA | D179→P180 | AGA→TCC | R212→S213 | | | |
| | GTA→TTG | V181→L182 | ATT→AAG | I213→K214 | | | |
| | ACC→AAG | T182→K183 | GAT→GCA | D214→A215 | | | |
| | CCT→TCA | P183→S184 | TCT→CAA | S215→Q216 | | | |
| | AAG→CCT | K184→P185 | ACT→GCA | T216→A217 | | | |
| | TTT→ATT | F209→I210 | TCT→CAT | S217→H218 | | | |
| | ATG→TCC | M212→S213 | GAT→AGC | D218→S219 | | | |
| | ATC→AAG | I213→K214 | GAT→CTC | D219→L220 | | | |
| | AAT→GCA | N214→A215 | TTG→GTG | L220→V221 | | | |
| | TCA→CAA | S215→Q216 | GTT→AGT | V221→S222 | | | |
| | ACA→GCA | T216→A217 | | | | | |
| | AGT→CAT | S217→H218 | | | | | |
| | GAT→AGC | D218→S219 | | | | | |
| | CAT→CTC | H219→L220 | | | | | |
| | TTA→GTG | L220→V221 | | | | | |
| | TAC→AGT | Y221→S222 | | | | | |
| | GAG→GAT | E238→D239 | | | | | |
| | AAA→CAA | K252→Q253 | | | | | |
| | CAA→AAA | Q292→K293 | | | | | |
| | CAA→GCT | Q321→A322 | | | | | |
| | GAA→GAT | E333→D334 | | | | | |
| | GCT→ACA | A345→T346 | | | | | |
| | AAT→ATT | N369→I370 | | | | | |

TABLE 32-continued

CVS Variants

| Mutant | Nucleotide changes vs. wildtype | Amino acid changes vs. wildtype | Nucleotide changes vs. CVS V19 | Amino acid changes vs. CVS V19 | SEQ ID NO nt | SEQ ID NO aa | Valencene production % vs. V19 (Shake Flask) |
|---|---|---|---|---|---|---|---|
| | TCT→TAC | S377→Y378 | | | | | |
| | ACA→AGA | T405→R406 | | | | | |
| | AAT→GGT | N429→G430 | | | | | |
| | GCA→TCT | A436→S437 | | | | | |
| | ACC→CCA | T501→P502 | | | | | |
| | GAT→GAA | D536→E537 | | | | | |
| V252 | AAA→CAA | K24Q | ACT→TTA | T53L | 786 | 843 | ND |
| | CAA→AAT | Q38N | GAT→GCA | D54A | | | |
| | ACA→TTA | T53L | GCA→ACC | A55T | | | |
| | GAT→GCA | D54A | GAA→GGA | E56G | | | |
| | GCT→ACC | A55T | GAT→AGG | D57R | | | |
| | GAA→GGA | E56G | CAA→AAA | Q58K | | | |
| | GAT→AGG | D57R | AAA→AGA | K62R | | | |
| | *AAG→AAA* | *K58K* | GCT→ATG | A85M | | | |
| | GTT→ATT | V60I | ATT→TTG | I86L | | | |
| | AAG→AGA | K62R | CAA→GAT | Q87D | | | |
| | GCA→ATG | A85M | CAA→CAC | Q88H | | | |
| | ATA→TTG | I86L | TTG→ATT | L89I | | | |
| | CAA→GAT | Q87D | TGT→TAC | C90Y | | | |
| | AAA→CAC | K88H | ---→AGA | ---→R91 | | | |
| | TTA→ATT | L89I | ---→GCT | ---→A92 | | | |
| | TGT→TAC | C90Y | ---→GAT | ---→D93 | | | |
| | ---→AGA | ---→R91 | *CCA→CCT* | *P91→P94* | | | |
| | ---→GCT | ---→A92 | ATT→TAT | I92→Y95 | | | |
| | ---→GAT | ---→D93 | CAT→TTT | H93→F96 | | | |
| | *CCA→CCT* | *P91→P94* | ATT→GAG | I94→E97 | | | |
| | ATC→TAT | I92→Y95 | GAT→GCT | D95→A98 | | | |
| | TAT→TTT | Y93→F96 | TCT→CAT | S96→H99 | | | |
| | ATT→GAG | I94→E97 | GAT→GAA | D97→E100 | | | |
| | GAC→GCT | D95→A98 | AAA→TAC | K98→Y101 | | | |
| | AGT→CAT | S96→H99 | GCT→AAT | A99→N102 | | | |
| | AAT→GAA | N97→E100 | *TCA→TCT* | *S174→S177* | | | |
| | AGA→TAC | R98→Y101 | TTG→--- | L175→--- | | | |
| | GCT→AAT | A99→N102 | GTT→--- | V176→--- | | | |
| | AAG→CAA | K125→Q128 | CAA→GCT | Q178→A179 | | | |
| | AAG→CAA | K173→Q176 | GAT→CCA | D179→P180 | | | |
| | *TCA→TCT* | *S174→S177* | GTT→TTG | V181→L182 | | | |
| | TTG→--- | L175→--- | ACT→AAG | T182→K183 | | | |
| | GTA→--- | V176→--- | CCA→TCA | P183→S184 | | | |
| | CAG→GCT | Q178→A179 | AGA→CCT | R184→P185 | | | |
| | GAT→CCA | D179→P180 | AGA→AGT | R212→S213 | | | |
| | GTA→TTG | V181→L182 | ATT→TTG | I213→L214 | | | |
| | ACC→AAG | T182→K183 | GAT→GTG | D214→V215 | | | |
| | CCT→TCA | P183→S184 | TCT→CGG | S215→R216 | | | |
| | AAG→CCT | K184→P185 | ACT→TCT | T216→S217 | | | |
| | TTT→ATT | F209→I210 | TCT→GAG | S217→E218 | | | |
| | ATG→AGT | M212→S213 | GAT→AAA | D218→K219 | | | |
| | ATC→TTG | I213→L214 | TTG→CCA | L220→P221 | | | |
| | AAT→GTG | N214→V215 | GTT→AAT | V221→N222 | | | |
| | TCA→CGG | S215→R216 | | | | | |
| | ACA→TCT | T216→S217 | | | | | |
| | AGT→GAG | S217→E218 | | | | | |
| | GAT→AAA | D218→K219 | | | | | |
| | CAT→GAT | H219→D220 | | | | | |
| | TTA→CCA | L220→P221 | | | | | |
| | TAC→AAT | Y221→N222 | | | | | |
| | GAG→GAT | E238→D239 | | | | | |
| | AAA→CAA | K252→Q253 | | | | | |
| | CAA→AAA | Q292→K293 | | | | | |
| | CAA→GCT | Q321→A322 | | | | | |
| | GAA→GAT | E333→D334 | | | | | |
| | GCT→ACA | A345→T346 | | | | | |
| | AAT→ATT | N369→I370 | | | | | |
| | TCT→TAC | S377→Y378 | | | | | |
| | ACA→AGA | T405→R406 | | | | | |
| | AAT→GGT | N429→G430 | | | | | |
| | GCA→TCT | A436→S437 | | | | | |
| | ACC→CCA | T501→P502 | | | | | |
| | GAT→GAA | D536→E537 | | | | | |

TABLE 32-continued

CVS Variants

| Mutant | Nucleotide changes vs. wildtype | Amino acid changes vs. wildtype | Nucleotide changes vs. CVS V19 | Amino acid changes vs. CVS V19 | SEQ ID NO nt | SEQ ID NO aa | Valencene production % vs. V19 (Shake Flask) |
|---|---|---|---|---|---|---|---|
| V253 | AGA→AAA | R19K | AGA→AAA | R19K | 787 | 844 | ND |
| | AAA→CAA | K24Q | ACT→TTA | T53L | | | |
| | CAA→AAT | Q38N | GAT→GCA | D54A | | | |
| | ACA→TTA | T53L | GCA→ACC | A55T | | | |
| | GAT→GCA | D54A | GAA→GGA | E56G | | | |
| | GCT→ACC | A55T | GAT→AGG | D57R | | | |
| | GAA→GGA | E56G | CAA→AAA | Q58K | | | |
| | GAT→AGG | D57R | GCT→ATG | A85M | | | |
| | *AAG→AAA* | *K58K* | ATT→TTG | I86L | | | |
| | GTT→ATT | V60I | CAA→GAT | Q87D | | | |
| | GCA→ATG | A85M | CAA→CAC | Q88H | | | |
| | ATA→TTG | I86L | TTG→ATT | L89I | | | |
| | CAA→GAT | Q87D | TGT→TAC | C90Y | | | |
| | AAA→CAC | K88H | ---→AGA | ---→R91 | | | |
| | TTA→ATT | L89I | ---→GCT | ---→A92 | | | |
| | TGT→TAC | C90Y | ---→GAT | ---→D93 | | | |
| | ---→AGA | ---→R91 | *CCA→CCT* | *P91→P94* | | | |
| | ---→GCT | ---→A92 | ATT→TAT | I92→Y95 | | | |
| | ---→GAT | ---→D93 | CAT→TTT | H93→F96 | | | |
| | *CCA→CCT* | *P91→P94* | ATT→GAG | I94→E97 | | | |
| | ATC→TAT | I92→Y95 | GAT→GCT | D95→A98 | | | |
| | TAT→TTT | Y93→F96 | TCT→CAT | S96→H99 | | | |
| | ATT→GAG | I94→E97 | GAT→GAA | D97→E100 | | | |
| | GAC→GCT | D95→A98 | AAA→TAC | K98→Y101 | | | |
| | AGT→CAT | S96→H99 | GCT→AAT | A99→N102 | | | |
| | AAT→GAA | N97→E100 | *TCA→TCT* | *S174→S177* | | | |
| | AGA→TAC | R98→Y101 | TTG→--- | L175→--- | | | |
| | GCT→AAT | A99→N102 | GTT→--- | V176→--- | | | |
| | AAG→CAA | K125→Q128 | CAA→GCT | Q178→A179 | | | |
| | AAG→CAA | K173→Q176 | GAT→CCA | D179→P180 | | | |
| | *TCA→TCT* | *S174→S177* | GTT→TTG | V181→L182 | | | |
| | TTG→--- | L175→--- | ACT→AAG | T182→K183 | | | |
| | GTA→--- | V176→--- | CCA→TCA | P183→S184 | | | |
| | CAG→GCT | Q178→A179 | AGA→CCT | R184→P185 | | | |
| | GAT→CCA | D179→P180 | AGA→CAT | R212→H213 | | | |
| | GTA→TTG | V181→L182 | ATT→CGC | I213→R214 | | | |
| | ACC→AAG | T182→K183 | GAT→ACT | D214→T215 | | | |
| | CCT→TCA | P183→S184 | TCT→CCA | S215→P216 | | | |
| | AAG→CCT | K184→P185 | ACT→GCT | T216→A217 | | | |
| | TTT→ATT | F209→I210 | TCT→TTC | S217→F218 | | | |
| | ATG→CAT | M212→H213 | GAT→TGC | D218→C219 | | | |
| | ATC→CGC | I213→R214 | GAT→AGA | D219→R220 | | | |
| | AAT→ACT | N214→T215 | TTG→GGC | L220→G221 | | | |
| | TCA→CCA | S215→P216 | GTT→GAA | V221→E222 | | | |
| | ACA→GCT | T216→A217 | | | | | |
| | AGT→TTC | S217→F218 | | | | | |
| | GAT→TGC | D218→C219 | | | | | |
| | CAT→AGA | H219→R220 | | | | | |
| | TTA→GGC | L220→G221 | | | | | |
| | TAC→GAA | Y221→E222 | | | | | |
| | GAG→GAT | E238→D239 | | | | | |
| | AAA→CAA | K252→Q253 | | | | | |
| | CAA→AAA | Q292→K293 | | | | | |
| | CAA→GCT | Q321→A322 | | | | | |
| | GAA→GAT | E333→D334 | | | | | |
| | GCT→ACA | A345→T346 | | | | | |
| | AAT→ATT | N369→I370 | | | | | |
| | TCT→TAC | S377→Y378 | | | | | |
| | ACA→AGA | T405→R406 | | | | | |
| | AAT→GGT | N429→G430 | | | | | |
| | GCA→TCT | A436→S437 | | | | | |
| | ACC→CCA | T501→P502 | | | | | |
| | GAT→GAA | D536→E537 | | | | | |
| V254 | AGA→AAA | R19K | AGA→AAA | R19K | 788 | 845 | ND |
| | AAA→CAA | K24Q | ACT→TTA | T53L | | | |
| | CAA→AAT | Q38N | GAT→GCA | D54A | | | |
| | ACA→TTA | T53L | GCA→ACC | A55T | | | |
| | GAT→GCA | D54A | GAA→GGA | E56G | | | |
| | GCT→ACC | A55T | GAT→AGG | D57R | | | |
| | GAA→GGA | E56G | CAA→AAA | Q58K | | | |

TABLE 32-continued

| CVS Variants | | | | | | |
|---|---|---|---|---|---|---|
| Mutant | Nucleotide changes vs. wildtype | Amino acid changes vs. wildtype | Nucleotide changes vs. CVS V19 | Amino acid changes vs. CVS V19 | SEQ ID NO nt aa | Valencene production % vs. V19 (Shake Flask) |
| | GAT→AGG | D57R | GCT→ATG | A85M | | |
| | *AAG→AAA* | *K58K* | ATT→TTG | I86L | | |
| | GTT→ATT | V60I | CAA→GAT | Q87D | | |
| | GCA→ATG | A85M | CAA→CAC | Q88H | | |
| | ATA→TTG | I86L | TTG→ATT | L89I | | |
| | CAA→GAT | Q87D | TGT→TAC | C90Y | | |
| | AAA→CAC | K88H | ---→AGA | ---→R91 | | |
| | TTA→ATT | L89I | ---→GCT | ---→A92 | | |
| | TGT→TAC | C90Y | ---→GAT | ---→D93 | | |
| | ---→AGA | ---→R91 | *CCA→CCT* | *P91→P94* | | |
| | ---→GCT | ---→A92 | ATT→TAT | I92→Y95 | | |
| | ---→GAT | ---→D93 | CAT→TTT | H93→F96 | | |
| | *CCA→CCT* | *P91→P94* | ATT→GAG | I94→E97 | | |
| | ATC→TAT | I92→Y95 | GAT→GCT | D95→A98 | | |
| | TAT→TTT | Y93→F96 | TCT→CAT | S96→H99 | | |
| | ATT→GAG | I94→E97 | GAT→GAA | D97→E100 | | |
| | GAC→GCT | D95→A98 | AAA→TAC | K98→Y101 | | |
| | AGT→CAT | S96→H99 | GCT→AAT | A99→N102 | | |
| | AAT→GAA | N97→E100 | *TCA→TCT* | *S174→S177* | | |
| | AGA→TAC | R98→Y101 | TTG→--- | L175→--- | | |
| | GCT→AAT | A99→N102 | GTT→--- | V176→--- | | |
| | AAG→CAA | K125→Q128 | CAA→GCT | Q178→A179 | | |
| | AAG→CAA | K173→Q176 | GAT→CCA | D179→P180 | | |
| | *TCA→TCT* | *S174→S177* | GTT→TTG | V181→L182 | | |
| | TTG→--- | L175→--- | ACT→AAG | T182→K183 | | |
| | GTA→--- | V176→--- | CCA→TCA | P183→S184 | | |
| | CAG→GCT | Q178→A179 | AGA→CCT | R184→P185 | | |
| | GAT→CCA | D179→P180 | AGA→CAG | R212→Q213 | | |
| | GTA→TTG | V181→L182 | ATT→GTG | I213→V214 | | |
| | ACC→AAG | T182→K183 | GAT→AGG | D214→R215 | | |
| | CCT→TCA | P183→S184 | TCT→AAG | S215→K216 | | |
| | AAG→CCT | K184→P185 | ACT→CGG | T216→R217 | | |
| | TTT→ATT | F209→I210 | TCT→TGT | S217→C218 | | |
| | ATG→CAG | M212→Q213 | GAT→GTA | D218→V219 | | |
| | ATC→GTG | I213→V214 | GAT→GAA | D219→E220 | | |
| | AAT→AGG | N214→R215 | TTG→GCA | L220→A221 | | |
| | TCA→AAG | S215→K216 | *GTT→GTG* | *V221→V222* | | |
| | ACA→CGG | T216→R217 | | | | |
| | AGT→TGT | S217→C218 | | | | |
| | GAT→GTA | D218→V219 | | | | |
| | CAT→GAA | H219→E220 | | | | |
| | TTA→GCA | L220→A221 | | | | |
| | TAC→GTG | Y221→V222 | | | | |
| | GAG→GAT | E238→D239 | | | | |
| | AAA→CAA | K252→Q253 | | | | |
| | CAA→AAA | Q292→K293 | | | | |
| | CAA→GCT | Q321→A322 | | | | |
| | GAA→GAT | E333→D334 | | | | |
| | GCT→ACA | A345→T346 | | | | |
| | AAT→ATT | N369→I370 | | | | |
| | TCT→TAC | S377→Y378 | | | | |
| | ACA→AGA | T405→R406 | | | | |
| | AAT→GGT | N429→G430 | | | | |
| | GCA→TCT | A436→S437 | | | | |
| | ACC→CCA | T501→P502 | | | | |
| | GAT→GAA | D536→E537 | | | | |
| V272 | AGA→AAA | R19K | AGA→AAA | R19K | 805 862 | |
| | AAA→CAA | K24Q | ACT→TTA | T53L | | |
| | CAA→AAT | Q38N | GAT→GCA | D54A | | |
| | ACA→TTA | T53L | GCA→ACC | A55T | | |
| | GAT→GCA | D54A | GAA→GGA | E56G | | |
| | GCT→ACC | A55T | GAT→AGG | D57R | | |
| | GAA→GGA | E56G | CAA→AAA | Q58K | | |
| | GAT→AGG | D57R | GCT→ATG | A85M | | |
| | *AAG→AAA* | *K58K* | ATT→TTG | I86L | | |
| | GTT→ATT | V60I | CAA→GAT | Q87D | | |
| | GCA→ATG | A85M | CAA→CAC | Q88H | | |
| | ATA→TTG | I86L | TTG→ATT | L89I | | |
| | CAA→GAT | Q87D | TGT→TAC | C90Y | | |
| | AAA→CAC | K88H | ---→AGA | ---→R91 | | |

TABLE 32-continued

| CVS Variants | | | | | | | |
|---|---|---|---|---|---|---|---|
| Mutant | Nucleotide changes vs. wildtype | Amino acid changes vs. wildtype | Nucleotide changes vs. CVS V19 | Amino acid changes vs. CVS V19 | SEQ ID NO nt | SEQ ID NO aa | Valencene production % vs. V19 (Shake Flask) |
| | TTA→ATT | L89I | ---→GCT | ---→A92 | | | |
| | TGT→TAC | C90Y | ---→GAT | ---→D93 | | | |
| | ---→AGA | ---→R91 | *CCA→CCT* | *P91→P94* | | | |
| | ---→GCT | ---→A92 | ATT→TAT | I92→Y95 | | | |
| | ---→GAT | ---→D93 | CAT→TTT | H93→F96 | | | |
| | *CCA→CCT* | *P91→P94* | ATT→GAG | I94→E97 | | | |
| | ATC→TAT | I92→Y95 | GAT→GCT | D95→A98 | | | |
| | TAT→TTT | Y93→F96 | TCT→CAT | S96→H99 | | | |
| | ATT→GAG | I94→E97 | GAT→GAA | D97→E100 | | | |
| | GAC→GCT | D95→A98 | AAA→TAC | K98→Y101 | | | |
| | AGT→CAT | S96→H99 | GCT→AAT | A99→N102 | | | |
| | AAT→GAA | N97→E100 | *TCA→TCT* | *S174→S177* | | | |
| | AGA→TAC | R98→Y101 | TTG→--- | L175→--- | | | |
| | GCT→AAT | A99→N102 | GTT→--- | V176→--- | | | |
| | AAG→CAA | K125→Q128 | CAA→GCT | Q178→A179 | | | |
| | AAG→CAA | K173→Q176 | GAT→CCA | D179→P180 | | | |
| | *TCA→TCT* | *S174→S177* | GTT→TTG | V181→L182 | | | |
| | TTG→--- | L175→--- | ACT→AAG | T182→K183 | | | |
| | GTA→--- | V176→--- | CCA→TCA | P183→S184 | | | |
| | CAG→GCT | Q178→A179 | AGA→CCT | R184→P185 | | | |
| | GAT→CCA | D179→P180 | AGA→GCC | R212→A213 | | | |
| | GTA→TTG | V181→L182 | ATT→TTT | I213→F214 | | | |
| | ACC→AAG | T182→K183 | GAT→CTG | D214→L215 | | | |
| | CCT→TCA | P183→S184 | TCT→GCT | S215→A216 | | | |
| | AAG→CCT | K184→P185 | ACT→TGC | T216→C217 | | | |
| | TTT→ATT | F209→I210 | TCT→GGC | S217→G218 | | | |
| | ATG→GCC | M212→A213 | GAT→CGT | D218→R219 | | | |
| | ATC→TTT | I213→F214 | GAT→CGA | D219→R220 | | | |
| | AAT→CTG | N214→L215 | TTG→CCC | L220→P221 | | | |
| | TCA→GCT | S215→A216 | GTT→ACA | V221→T222 | | | |
| | ACA→TGC | T216→C217 | TTG→TGC | L313→C314 | | | |
| | AGT→GGC | S217→G218 | TCT→ACG | S314→T315 | | | |
| | GAT→CGT | D218→R219 | TTG→ATG | L315→M316 | | | |
| | CAT→CGA | H219→R220 | ACC→AGT | T317→S318 | | | |
| | TTA→CCC | L220→P221 | AAG→CGA | K336→R337 | | | |
| | TAC→ACA | Y221→T222 | TTA→ATT | L337→I338 | | | |
| | GAG→GAT | E238→D239 | GGT→CGG | G357→R358 | | | |
| | AAA→CAA | K252→Q253 | | | | | |
| | CAA→AAA | Q292→K293 | | | | | |
| | CTC→TGC | L313→C314 | | | | | |
| | AGC→ACG | S314→T315 | | | | | |
| | CTC→ATG | L315→M316 | | | | | |
| | ACT→AGT | T317→S318 | | | | | |
| | CAA→GCT | Q321→A322 | | | | | |
| | GAA→GAT | E333→D334 | | | | | |
| | AAA→CGA | K336→R337 | | | | | |
| | TTG→ATT | L337→I338 | | | | | |
| | GCT→ACA | A345→T346 | | | | | |
| | GGA→CGG | G357→R358 | | | | | |
| | AAT→ATT | N369→I370 | | | | | |
| | TCT→TAC | S377→Y378 | | | | | |
| | ACA→AGA | T405→R406 | | | | | |
| | AAT→GGT | N429→G430 | | | | | |
| | GCA→TCT | A436→S437 | | | | | |
| | ACC→CCA | T501→P502 | | | | | |
| | GAT→GAA | D536→E537 | | | | | |

g. V256, V257, V258, V259, V261, V263, V264, V262, V260, V265, V266 and V273

In CVS variants V256, V257, V258, V259, V261, V263, V264, V262, V260, V265, V266 and V273, amino acids 53-58 were replaced by amino acids 58-63 of TEAS (SEQ ID NO:941), amino acids 85-99 were replaced by amino acids 93-110 of HPS (SEQ ID NO:942) and amino acids 174-184 were replaced by amino acids 185-193 of HPS (SEQ ID NO:942) or 177-185 of TEAS (SEQ ID NO:941) as described above. Some variants that were generated using V243 or V244 as templates also contained amino acids 212-221 replaced by amino acids 213-221 of TEAS. These variants additionally contain mutations from V75. In addition, amino acids 2-7 were replaced by random amino acids. These CVS variants were generated by direct yeast recombination using mutagenic primers mutCVS2-7 and revAA2-7rnd (see Table 18) using V240, V243 or V244 as templates. The variants, including amino acid and nucleotide changes versus both wildtype CVS and CVS V19, and valencene production % versus CVS V19 are set forth in Table 33 below.

TABLE 33

CVS Variants

| Mutant | Nucleotide changes vs. wildtype | Amino acid changes vs. wildtype | Nucleotide changes vs. CVS V19 | Amino acid changes vs. CVS V19 | SEQ ID NO nt | SEQ ID NO aa | Valencene production % vs. V19 (Shake Flask) |
|---|---|---|---|---|---|---|---|
| V256 | TCG→CAA | S2Q | TCA→CAA | S2Q | 790 | 847 | 74.3 |
| | TCT→ACG | S3T | TCT→ACG | S3T | | | |
| | GGA→TTT | G4F | GGT→TTT | G4F | | | |
| | GAA→AAC | E5N | GAA→AAC | E5N | | | |
| | ACA→TGT | T6C | ACT→TGT | T6C | | | |
| | TTT→GCT | F7A | TTT→GCT | F7A | | | |
| | AGA→AAA | R19K | AGA→AAA | R19K | | | |
| | AAA→CAA | K24Q | ACT→TTA | T53L | | | |
| | CAA→AAT | Q38N | GAT→GCA | D54A | | | |
| | ACA→TTA | T53L | GCA→ACC | A55T | | | |
| | GAT→GCA | D54A | GAA→GGA | E56G | | | |
| | GCT→ACC | A55T | GAT→AGG | D57R | | | |
| | GAA→GGA | E56G | CAA→AAA | Q58K | | | |
| | GAT→AGG | D57R | GCT→ATG | A85M | | | |
| | *AAG→AAA* | *K58K* | ATT→TTG | I86L | | | |
| | GTT→ATT | V60I | CAA→GAT | Q87D | | | |
| | GCA→ATG | A85M | CAA→CAC | Q88H | | | |
| | ATA→TTG | I86L | TTG→ATT | L89I | | | |
| | CAA→GAT | Q87D | TGT→TAC | C90Y | | | |
| | AAA→CAC | K88H | ---→AGA | ---→R91 | | | |
| | TTA→ATT | L89I | ---→GCT | ---→A92 | | | |
| | TGT→TAC | C90Y | ---→GAT | ---→D93 | | | |
| | ---→AGA | ---→R91 | *CCA→CCT* | *P91→P94* | | | |
| | ---→GCT | ---→A92 | ATT→TAT | I92→Y95 | | | |
| | ---→GAT | ---→D93 | CAT→TTT | H93→F96 | | | |
| | *CCA→CCT* | *P91→P94* | ATT→GAG | I94→E97 | | | |
| | ATC→TAT | I92→Y95 | GAT→GCT | D95→A98 | | | |
| | TAT→TTT | Y93→F96 | TCT→CAT | S96→H99 | | | |
| | ATT→GAG | I94→E97 | GAT→GAA | D97→E100 | | | |
| | GAC→GCT | D95→A98 | AAA→TAC | K98→Y101 | | | |
| | AGT→CAT | S96→H99 | GCT→AAT | A99→N102 | | | |
| | AAT→GAA | N97→E100 | *TCA→TCT* | *S174→S177* | | | |
| | AGA→TAC | R98→Y101 | TTG→--- | L175→--- | | | |
| | GCT→AAT | A99→N102 | GTT→--- | V176→--- | | | |
| | AAG→CAA | K125→Q128 | CAA→GCT | Q178→A179 | | | |
| | AAG→CAA | K173→Q176 | GAT→CCA | D179→P180 | | | |
| | *TCA→TCT* | *S174→S177* | GTT→TTG | V181→L182 | | | |
| | TTG→--- | L175→---- | ACT→AAG | T182→K183 | | | |
| | GTA→--- | V176→---- | CCA→TCA | P183→S184 | | | |
| | CAG→GCT | Q178→A179 | AGA→CCT | R184→P185 | | | |
| | GAT→CCA | D179→P180 | AGA→TCA | R212→S213 | | | |
| | GTA→TTG | V181→L182 | *ATT→ATC* | *I213→I214* | | | |
| | ACC→AAG | T182→K183 | GAT→TAT | D214→Y215 | | | |
| | CCT→TCA | P183→S184 | TCT→GAC | S215→D216 | | | |
| | AAG→CCT | K184→P185 | ACT→AAG | T216→K217 | | | |
| | TTT→ATT | F209→I210 | TCT→--- | S217-- | | | |
| | ATG→TCA | M212→S213 | GAT→GAA | D218E | | | |
| | AAT→TAT | N214→Y215 | GAT→CAA | D219Q | | | |
| | TCA→GAC | S215→D216 | TTG→TCG | L220S | | | |
| | ACA→AAG | T216→K217 | GTT→AAG | V221K | | | |
| | AGT→--- | S217→--- | *GGT→GGG* | *G276G* | | | |
| | GAT→GAA | D218E | CCA→TCA | P281S | | | |
| | CAT→CAA | H219Q | TTG→TGC | L313C | | | |
| | TTA→TCG | L220S | TCT→ACG | S314T | | | |
| | TAC→AAG | Y221K | TTG→ATG | L315M | | | |
| | GAG→GAT | E238D | ACC→AGT | T317S | | | |
| | AAA→CAA | K252Q | *GAC→GAT* | *D329D* | | | |
| | CCT→TCA | P281S | AAG→CGA | K336R | | | |
| | CAA→AAA | Q292K | TTA→ATT | L337I | | | |
| | CTC→TGC | L313C | GGT→CGG | G357R | | | |
| | AGC→ACG | S314T | GAG→GAT | E484D | | | |
| | CTC→ATG | L315M | | | | | |
| | ACT→AGT | T317S | | | | | |
| | CAA→GCT | Q321A | | | | | |
| | GAA→GAT | E333D | | | | | |
| | AAA→CGA | K336R | | | | | |
| | TTG→ATT | L337I | | | | | |
| | GCT→ACA | A345T | | | | | |
| | GGA→CGG | G357R | | | | | |
| | AAT→ATT | N369I | | | | | |
| | TCT→TAC | S377Y | | | | | |

TABLE 33-continued

| CVS Variants | | | | | | | |
|---|---|---|---|---|---|---|---|
| Mutant | Nucleotide changes vs. wildtype | Amino acid changes vs. wildtype | Nucleotide changes vs. CVS V19 | Amino acid changes vs. CVS V19 | SEQ ID NO nt | SEQ ID NO aa | Valencene production % vs. V19 (Shake Flask) |
| | ACA→AGA | T405R | | | | | |
| | AAT→GGT | N429G | | | | | |
| | GCA→TCT | A436S | | | | | |
| | GAA→GAT | E484D | | | | | |
| | ACC→CCA | T501P | | | | | |
| | GAT→GAA | D536E | | | | | |
| V257 | TCG→GCA | S2A | TCA→GCA | S2A | 791 | 848 | ND |
| | TCT→GGC | S3G | TCT→GGC | S3G | | | |
| | GGA→CGG | G4R | GGT→CGG | G4R | | | |
| | GAA→GGG | E5G | GAA→GGG | E5G | | | |
| | ACA→GCG | T6A | ACT→GCG | T6A | | | |
| | TTT→TCC | F7S | TTT→TCC | F7S | | | |
| | AGA→AAA | R19K | AGA→AAA | R19K | | | |
| | AAA→CAA | K24Q | ACT→TTA | T53L | | | |
| | CAA→AAT | Q38N | GAT→GCA | D54A | | | |
| | ACA→TTA | T53L | GCA→ACC | A55T | | | |
| | GAT→GCA | D54A | GAA→GGA | E56G | | | |
| | GCT→ACC | A55T | GAT→AGG | D57R | | | |
| | GAA→GGA | E56G | CAA→AAA | Q58K | | | |
| | GAT→AGG | D57R | GCT→ATG | A85M | | | |
| | *AAG→AAA* | *K58K* | ATT→TTG | I86L | | | |
| | GTT→ATT | V60I | CAA→GAT | Q87D | | | |
| | GCA→ATG | A85M | CAA→CAC | Q88H | | | |
| | ATA→TTG | I86L | TTG→ATT | L89I | | | |
| | CAA→GAT | Q87D | TGT→TAC | C90Y | | | |
| | AAA→CAC | K88H | ---→AGA | ---→R91 | | | |
| | TTA→ATT | L89I | ---→GCT | ---→A92 | | | |
| | TGT→TAC | C90Y | ---→GAT | ---→D93 | | | |
| | ---→AGA | ---→R91 | *CCA→CCT* | *P91→P94* | | | |
| | ---→GCT | ---→A92 | ATT→TAT | I92→Y95 | | | |
| | ---→GAT | ---→D93 | CAT→TTT | H93→F96 | | | |
| | *CCA→CCT* | *P91→P94* | ATT→GAG | I94→E97 | | | |
| | ATC→TAT | I92→Y95 | GAT→GCT | D95→A98 | | | |
| | TAT→TTT | Y93→F96 | TCT→CAT | S96→H99 | | | |
| | ATT→GAG | I94→E97 | GAT→GAA | D97→E100 | | | |
| | GAC→GCT | D95→A98 | AAA→TAC | K98→Y101 | | | |
| | AGT→CAT | S96→H99 | GCT→AAT | A99→N102 | | | |
| | AAT→GAA | N97→E100 | *TCA→TCT* | *S174→S177* | | | |
| | AGA→TAC | R98→Y101 | TTG→--- | L175→--- | | | |
| | GCT→AAT | A99→N102 | GTT→--- | V176→--- | | | |
| | AAG→CAA | K125→Q128 | CAA→GCT | Q178→A179 | | | |
| | AAG→CAA | K173→Q176 | GAT→CCA | D179→P180 | | | |
| | *TCA→TCT* | *S174→S177* | GTT→TTG | V181→L182 | | | |
| | TTG→--- | L175→--- | ACT→AAG | T182→K183 | | | |
| | GTA→--- | V176→--- | CCA→TCA | P183→S184 | | | |
| | CAG→GCT | Q178→A179 | AGA→CCT | R184→P185 | | | |
| | GAT→CCA | D179→P180 | AGA→TCA | R212→S213 | | | |
| | GTA→TTG | V181→L182 | *ATT→ATC* | *I213→I214* | | | |
| | ACC→AAG | T182→K183 | GAT→TAT | D214→Y215 | | | |
| | CCT→TCA | P183→S184 | TCT→GAC | S215→D216 | | | |
| | AAG→CCT | K184→P185 | ACT→AAG | T216→K217 | | | |
| | TTT→ATT | F209→I210 | TCT→--- | S217-- | | | |
| | ATG→TCA | M212→S213 | GAT→GAA | D218E | | | |
| | AAT→TAT | N214→Y215 | GAT→CAA | D219Q | | | |
| | TCA→GAC | S215→D216 | TTG→TCG | L220S | | | |
| | ACA→AAG | T216→K217 | GTT→AAG | V221K | | | |
| | AGT→--- | S217→--- | *GGT→GGG* | *G276G* | | | |
| | GAT→GAA | D218E | CCA→TCA | P281S | | | |
| | CAT→CAA | H219Q | TTG→TGC | L313C | | | |
| | TTA→TCG | L220S | TCT→ACG | S314T | | | |
| | TAC→AAG | Y221K | TTG→ATG | L315M | | | |
| | GAG→GAT | E238D | ACC→AGT | T317S | | | |
| | AAA→CAA | K252Q | *GAC→GAT* | *D329D* | | | |
| | CCT→TCA | P281S | AAG→CGA | K336R | | | |
| | CAA→AAA | Q292K | TTA→ATT | L337I | | | |
| | CTC→TGC | L313C | GGT→CGG | G357R | | | |
| | AGC→ACG | S314T | *GAA→GAG* | *E368E* | | | |
| | CTC→ATG | L315M | GAG→GAT | E484D | | | |
| | ACT→AGT | T317S | *GCT→GCC* | *A517A* | | | |
| | CAA→GCT | Q321A | | | | | |

TABLE 33-continued

CVS Variants

| Mutant | Nucleotide changes vs. wildtype | Amino acid changes vs. wildtype | Nucleotide changes vs. CVS V19 | Amino acid changes vs. CVS V19 | SEQ ID NO nt | SEQ ID NO aa | Valencene production % vs. V19 (Shake Flask) |
|---|---|---|---|---|---|---|---|
| | GAA→GAT | E333D | | | | | |
| | AAA→CGA | K336R | | | | | |
| | TTG→ATT | L337I | | | | | |
| | GCT→ACA | A345T | | | | | |
| | GGA→CGG | G357R | | | | | |
| | AAT→ATT | N369I | | | | | |
| | TCT→TAC | S377Y | | | | | |
| | ACA→AGA | T405R | | | | | |
| | AAT→GGT | N429G | | | | | |
| | GCA→TCT | A436S | | | | | |
| | GAA→GAT | E484D | | | | | |
| | ACC→CCA | T501P | | | | | |
| | *GCA→GCC* | *A517A* | | | | | |
| | GAT→GAA | D536E | | | | | |
| V258 | TCG→GTT | S2V | TCA→GTT | S2V | 792 | 849 | ND |
| | TCT→CTC | S3L | TCT→CTC | S3L | | | |
| | GGA→AAA | G4K | GGT→AAA | G4K | | | |
| | GAA→TCC | E5S | GAA→TCC | E5S | | | |
| | ACA→AAG | T6K | ACT→AAG | T6K | | | |
| | TTT→CGC | F7R | TTT→CGC | F7R | | | |
| | AGA→AAA | R19K | AGA→AAA | R19K | | | |
| | AAA→CAA | K24Q | ACT→TTG | T53L | | | |
| | CAA→AAT | Q38N | GAT→GCA | D54A | | | |
| | ACA→TTG | T53L | GCA→ACC | A55T | | | |
| | GAT→GCA | D54A | GAA→GGA | E56G | | | |
| | GCT→ACC | A55T | GAT→AGG | D57R | | | |
| | GAA→GGA | E56G | CAA→AAA | Q58K | | | |
| | GAT→AGG | D57R | GCT→ATG | A85M | | | |
| | *AAG→AAA* | *K58K* | ATT→TTG | I86L | | | |
| | GTT→ATT | V60I | CAA→GAT | Q87D | | | |
| | GCA→ATG | A85M | CAA→CAC | Q88H | | | |
| | ATA→TTG | I86L | TTG→ATT | L89I | | | |
| | CAA→GAT | Q87D | TGT→TAC | C90Y | | | |
| | AAA→CAC | K88H | ---→AGA | ---→R91 | | | |
| | TTA→ATT | L89I | ---→GCT | ---→A92 | | | |
| | TGT→TAC | C90Y | ---→GAT | ---→D93 | | | |
| | ---→AGA | ---→R91 | *CCA→CCT* | *P91→P94* | | | |
| | ---→GCT | ---→A92 | ATT→TAT | I92→Y95 | | | |
| | ---→GAT | ---→D93 | CAT→TTT | H93→F96 | | | |
| | *CCA→CCT* | *P91→P94* | ATT→GAG | I94→E97 | | | |
| | ATC→TAT | I92→Y95 | GAT→GCT | D95→A98 | | | |
| | TAT→TTT | Y93→F96 | TCT→CAT | S96→H99 | | | |
| | ATT→GAG | I94→E97 | GAT→GAA | D97→E100 | | | |
| | GAC→GCT | D95→A98 | AAA→TAC | K98→Y101 | | | |
| | AGT→CAT | S96→H99 | GCT→AAT | A99→N102 | | | |
| | AAT→GAA | N97→E100 | *TCA→TCT* | *S174→S177* | | | |
| | AGA→TAC | R98→Y101 | TTG→--- | L175→--- | | | |
| | GCT→AAT | A99→N102 | GTT→--- | V176→-- | | | |
| | AAG→CAA | K125→Q128 | CAA→GCT | Q178→A179 | | | |
| | AAG→CAA | K173→Q176 | GAT→CCA | D179→P180 | | | |
| | *TCA→TCT* | *S174→S177* | GTT→TTG | V181→L182 | | | |
| | TTG→--- | L175→--- | ACT→AAG | T182→K183 | | | |
| | GTA→--- | V176→--- | CCA→TCA | P183→S184 | | | |
| | CAG→GCT | Q178→A179 | AGA→CCT | R184→P185 | | | |
| | GAT→CCA | D179→P180 | AGA→TCA | R212→S2I3 | | | |
| | GTA→TTG | V181→L182 | *ATT→ATC* | *I213→I214* | | | |
| | ACC→AAG | T182→K183 | GAT→TAT | D214→Y215 | | | |
| | CCT→TCA | P183→S184 | TCT→GAC | S215→D216 | | | |
| | AAG→CCT | K184→P185 | ACT→AAG | T216→K217 | | | |
| | TTT→ATT | F209→I210 | TCT→--- | S217 →-- | | | |
| | ATG→TCA | M212→S213 | GAT→GAA | D218E | | | |
| | AAT→TAT | N214→Y215 | GAT→CAA | D219Q | | | |
| | TCA→GAC | S215→D2I6 | TTG→TCG | L220S | | | |
| | ACA→AAG | T216→K217 | GTT→AAG | V221K | | | |
| | AGT→--- | S217→--- | *GGT→GGG* | *G276G* | | | |
| | GAT→GAA | D218E | CCA→TCA | P281S | | | |
| | CAT→CAA | H219Q | TTG→TGC | L313C | | | |
| | TTA→TCG | L220S | TCT→ACG | S314T | | | |
| | TAC→AAG | Y221K | TTG→ATG | L315M | | | |
| | GAG→GAT | E238D | ACC→AGT | T317S | | | |

TABLE 33-continued

CVS Variants

| Mutant | Nucleotide changes vs. wildtype | Amino acid changes vs. wildtype | Nucleotide changes vs. CVS V19 | Amino acid changes vs. CVS V19 | SEQ ID NO nt | SEQ ID NO aa | Valencene production % vs. V19 (Shake Flask) |
|---|---|---|---|---|---|---|---|
| | AAA→CAA | K252Q | *GAC→GAT* | *D329D* | | | |
| | CCT→TCA | P281S | AAG→CGA | K336R | | | |
| | CAA→AAA | Q292K | TTA→ATT | L337I | | | |
| | CTC→TGC | L313C | GGT→CGG | G357R | | | |
| | AGC→ACG | S314T | GAG→GAT | E484D | | | |
| | CTC→ATG | L315M | | | | | |
| | ACT→AGT | T317S | | | | | |
| | CAA→GCT | Q321A | | | | | |
| | GAA→GAT | E333D | | | | | |
| | AAA→CGA | K336R | | | | | |
| | TTG→ATT | L337I | | | | | |
| | GCT→ACA | A345T | | | | | |
| | GGA→CGG | G357R | | | | | |
| | AAT→ATT | N369I | | | | | |
| | TCT→TAC | S377Y | | | | | |
| | ACA→AGA | T405R | | | | | |
| | AAT→GGT | N429G | | | | | |
| | GCA→TCT | A436S | | | | | |
| | GAA→GAT | E484D | | | | | |
| | ACC→CCA | T501P | | | | | |
| | GAT→GAA | D536E | | | | | |
| V259 and | TCG→AAA | S2K | TCA→AAA | S2K | 793 | 850 | 104.14 |
| V260 | TCT→GAA | S3E | TCT→GAA | S3E | | | |
| | GGA→TGT | G4C | GGT→TGT | G4C | | | |
| | GAA→ACG | E5T | GAA→ACG | E5T | | | |
| | ACA→ATG | T6M | ACT→ATG | T6M | | | |
| | TTT→TTA | F7L | TTT→TTA | F7L | | | |
| | AGA→AAA | R19K | AGA→AAA | R19K | | | |
| | AAA→CAA | K24Q | ACT→TTA | T53L | | | |
| | CAA→AAT | Q38N | GAT→GCA | D54A | | | |
| | ACA→TTA | T53L | GCA→ACC | A55T | | | |
| | GAT→GCA | D54A | GAA→GGA | E56G | | | |
| | GCT→ACC | A55T | GAT→AGG | D57R | | | |
| | GAA→GGA | E56G | CAA→AAA | Q58K | | | |
| | GAT→AGG | D57R | GCT→ATG | A85M | | | |
| | *AAG→AAA* | *K58K* | ATT→TTG | I86L | | | |
| | GTT→ATT | V60I | CAA→GAT | Q87D | | | |
| | GCA→ATG | A85M | CAA→CAC | Q88H | | | |
| | ATA→TTG | I86L | TTG→ATT | L89I | | | |
| | CAA→GAT | Q87D | TGT→TAC | C90Y | | | |
| | AAA→CAC | K88H | ---→AGA | ---→R91 | | | |
| | TTA→ATT | L89I | ---→GCT | ---→A92 | | | |
| | TGT→TAC | C90Y | ---→GAT | ---→D93 | | | |
| | ---→AGA | ---→R91 | *CCA→CCT* | *P91→P94* | | | |
| | ---→GCT | ---→A92 | ATT→TAT | I92→Y95 | | | |
| | ---→GAT | ---→D93 | CAT→TTT | H93→F96 | | | |
| | *CCA→CCT* | *P91→P94* | ATT→GAG | I94→E97 | | | |
| | ATC→TAT | I92→Y95 | GAT→GCT | D95→A98 | | | |
| | TAT→TTT | Y93→F96 | TCT→CAT | S96→H99 | | | |
| | ATT→GAG | I94→E97 | GAT→GAA | D97→E100 | | | |
| | GAC→GCT | D95→A98 | AAA→TAC | K98→Y101 | | | |
| | AGT→CAT | S96→H99 | GCT→AAT | A99→N102 | | | |
| | AAT→GAA | N97→E100 | *TCA→TCT* | *S174→S177* | | | |
| | AGA→TAC | R98→Y101 | TTG→--- | L175→--- | | | |
| | GCT→AAT | A99→N102 | GTT→--- | V176→--- | | | |
| | AAG→CAA | K125→Q128 | CAA→GCT | Q178→A179 | | | |
| | AAG→CAA | K173→Q176 | GAT→CCA | D179→P180 | | | |
| | *TCA→TCT* | *S174→S177* | GTT→TTG | V181→L182 | | | |
| | TTG→--- | L175→--- | ACT→AAG | T182→K183 | | | |
| | GTA→--- | V176→--- | CCA→TCA | P183→S184 | | | |
| | CAG→GCT | Q178→A179 | AGA→CCT | R184→P185 | | | |
| | GAT→CCA | D179→P180 | AGA→TCA | R212→S213 | | | |
| | GTA→TTG | V181→L182 | *ATT→ATC* | *I213→I214* | | | |
| | ACC→AAG | T182→K183 | GAT→TAT | D214→Y215 | | | |
| | CCT→TCA | P183→S184 | TCT→GAC | S215→D216 | | | |
| | AAG→CCT | K184→P185 | ACT→AAG | T216→K217 | | | |
| | TTT→ATT | F209→I210 | TCT→--- | S217→-- | | | |
| | ATG→TCA | M212→S213 | GAT→GAA | D218E | | | |
| | AAT→TAT | N214→Y215 | GAT→CAA | D219Q | | | |
| | TCA→GAC | S215→D216 | TTG→TCG | L220S | | | |

TABLE 33-continued

CVS Variants

| Mutant | Nucleotide changes vs. wildtype | Amino acid changes vs. wildtype | Nucleotide changes vs. CVS V19 | Amino acid changes vs. CVS V19 | SEQ ID NO nt | SEQ ID NO aa | Valencene production % vs. V19 (Shake Flask) |
|---|---|---|---|---|---|---|---|
| | ACA→AAG | T216→K217 | GTT→AAG | V221K | | | |
| | AGT→--- | S217→-- | *GGT→GGG* | *G276G* | | | |
| | GAT→GAA | D218E | CCA→TCA | P281S | | | |
| | CAT→CAA | H219Q | TTG→TGC | L313C | | | |
| | TTA→TCG | L220S | TCT→ACG | S314T | | | |
| | TAC→AAG | Y221K | TTG→ATG | L315M | | | |
| | GAG→GAT | E238D | ACC→AGT | T317S | | | |
| | AAA→CAA | K252Q | *GAC→GAT* | *D329D* | | | |
| | CCT→TCA | P281S | AAG→CGA | K336R | | | |
| | CAA→AAA | Q292K | TTA→ATT | L337I | | | |
| | CTC→TGC | L313C | GGT→CGG | G357R | | | |
| | AGC→ACG | S314T | *AAA→AAG* | *K468K* | | | |
| | CTC→ATG | L315M | GAG→GAT | E484D | | | |
| | ACT→AGT | T317S | | | | | |
| | CAA→GCT | Q321A | | | | | |
| | GAA→GAT | E333D | | | | | |
| | AAA→CGA | K336R | | | | | |
| | TTG→ATT | L337I | | | | | |
| | GCT→ACA | A345T | | | | | |
| | GGA→CGG | G357R | | | | | |
| | AAT→ATT | N369I | | | | | |
| | TCT→TAC | S377Y | | | | | |
| | ACA→AGA | T405R | | | | | |
| | AAT→GGT | N429G | | | | | |
| | GCA→TCT | A436S | | | | | |
| | GAA→GAT | E484D | | | | | |
| | ACC→CCA | T501P | | | | | |
| | GAT→GAA | D536E | | | | | |
| V261 | TCG→CCA | S2P | TCA→CCA | S2P | 794 | 851 | ND |
| and | AGA→AAA | R19K | AGA→AAA | R19K | | | |
| V262 | AAA→CAA | K24Q | ACT→TTA | T53L | | | |
| | CAA→AAT | Q38N | GAT→GCA | D54A | | | |
| | ACA→TTA | T53L | GCA→ACC | A55T | | | |
| | GAT→GCA | D54A | GAA→GGA | E56G | | | |
| | GCT→ACC | A55T | GAT→AGG | D57R | | | |
| | GAA→GGA | E56G | CAA→AAA | Q58K | | | |
| | GAT→AGG | D57R | GCT→ATG | A85M | | | |
| | *AAG→AAA* | *K58K* | ATT→TTG | I86L | | | |
| | GTT→ATT | V60I | CAA→GAT | Q87D | | | |
| | GCA→ATG | A85M | CAA→CAC | Q88H | | | |
| | ATA→TTG | I86L | TTG→ATT | L89I | | | |
| | CAA→GAT | Q87D | TGT→TAC | C90Y | | | |
| | AAA→CAC | K88H | ---→AGA | ---→R91 | | | |
| | TTA→ATT | L89I | ---→GCT | ---→A92 | | | |
| | TGT→TAC | C90Y | ---→GAT | ---→D93 | | | |
| | ---→AGA | ---→R91 | *CCA→CCT* | *P91→P94* | | | |
| | ---→GCT | ---→A92 | ATT→TAT | I92→Y95 | | | |
| | ---→GAT | ---→D93 | CAT→TTT | H93→F96 | | | |
| | *CCA→CCT* | *P91→P94* | ATT→GAG | I94→E97 | | | |
| | ATC→TAT | I92→Y95 | GAT→GCT | D95→A98 | | | |
| | TAT→TTT | Y93→F96 | TCT→CAT | S96→H99 | | | |
| | ATT→GAG | I94→E97 | GAT→GAA | D97→E100 | | | |
| | GAC→GCT | D95→A98 | AAA→TAC | K98→Y101 | | | |
| | AGT→CAT | S96→H99 | GCT→AAT | A99→N102 | | | |
| | AAT→GAA | N97→E100 | *TCA→TCT* | *S174→S177* | | | |
| | AGA→TAC | R98→Y101 | TTG→--- | L175→--- | | | |
| | GCT→AAT | A99→N102 | GTT→--- | V176→--- | | | |
| | AAG→CAA | K125→Q128 | CAA→GCT | Q178→A179 | | | |
| | AAG→CAA | K173→Q176 | GAT→CCA | D179→P180 | | | |
| | *TCA→TCT* | *S174→S177* | GTT→TTG | V181→L182 | | | |
| | TTG→--- | L175→--- | ACT→AAG | T182→K183 | | | |
| | GTA→--- | V176→--- | CCA→TCA | P183→S184 | | | |
| | CAG→GCT | Q178→A179 | AGA→CCT | R184→P185 | | | |
| | GAT→CCA | D179→P180 | AGA→TCA | R212→S213 | | | |
| | GTA→TTG | V181→L182 | *ATT→ATC* | *I213→I214* | | | |
| | ACC→AAG | T182→K183 | GAT→TAT | D214→Y215 | | | |
| | CCT→TCA | P183→S184 | TCT→GAC | S215→D216 | | | |
| | AAG→CCT | K184→P185 | ACT→AAG | T216→K217 | | | |
| | TTT→ATT | F209→I210 | TCT→--- | S217→-- | | | |
| | ATG→TCA | M212→S213 | GAT→GAA | D218E | | | |

TABLE 33-continued

| CVS Variants | | | | | | | |
|---|---|---|---|---|---|---|---|
| Mutant | Nucleotide changes vs. wildtype | Amino acid changes vs. wildtype | Nucleotide changes vs. CVS V19 | Amino acid changes vs. CVS V19 | SEQ ID NO nt | SEQ ID NO aa | Valencene production % vs. V19 (Shake Flask) |
| | AAT→TAT | N214→Y215 | GAT→CAA | D219Q | | | |
| | TCA→GAC | S215→D216 | TTG→TCG | L220S | | | |
| | ACA→AAG | T216→K217 | GTT→AAG | V221K | | | |
| | AGT→--- | S217→-- | *GGT→GGG* | *G276G* | | | |
| | GAT→GAA | D218E | CCA→TCA | P281S | | | |
| | CAT→CAA | H219Q | TTG→TGC | L313C | | | |
| | TTA→TCG | L220S | TCT→ACG | S314T | | | |
| | TAC→AAG | Y221K | TTG→ATG | L315M | | | |
| | GAG→GAT | E238D | ACC→AGT | T317S | | | |
| | AAA→CAA | K252Q | *GAC→GAT* | *D329D* | | | |
| | CCT→TCA | P281S | AAG→CGA | K336R | | | |
| | CAA→AAA | Q292K | TTA→ATT | L337I | | | |
| | CTC→TGC | L313C | GGT→CGG | G357R | | | |
| | AGC→ACG | S314T | GAG→GAT | E484D | | | |
| | CTC→ATG | L315M | | | | | |
| | ACT→AGT | T317S | | | | | |
| | CAA→GCT | Q321A | | | | | |
| | GAA→GAT | E333D | | | | | |
| | AAA→CGA | K336R | | | | | |
| | TTG→ATT | L337I | | | | | |
| | GCT→ACA | A345T | | | | | |
| | GGA→CGG | G357R | | | | | |
| | AAT→ATT | N369I | | | | | |
| | TCT→TAC | S377Y | | | | | |
| | ACA→AGA | T405R | | | | | |
| | AAT→GGT | N429G | | | | | |
| | GCA→TCT | A436S | | | | | |
| | GAA→GAT | E484D | | | | | |
| | ACC→CCA | T501P | | | | | |
| | GAT→GAA | D536E | | | | | |
| V263 | TCG→TGC | S2C | TCA→TGC | S2C | 795 | 852 | 114.57 |
| | TCT→ATG | S3M | TCT→ATG | S3M | | | |
| | GGA→ACA | G4T | GGT→ACA | G4T | | | |
| | GAA→GGT | E5G | GAA→GGT | E5G | | | |
| | ACA→GAA | T6E | ACT→GAA | T6E | | | |
| | TTT→TCG | F7S | TTT→TCG | F7S | | | |
| | AGA→AAA | R19K | AGA→AAA | R19K | | | |
| | AAA→CAA | K24Q | ACT→TTA | T53L | | | |
| | CAA→AAT | Q38N | GAT→GCA | D54A | | | |
| | ACA→TTA | T53L | GCA→ACC | A55T | | | |
| | GAT→GCA | D54A | GAA→GGA | E56G | | | |
| | GCT→ACC | A55T | GAT→AGG | D57R | | | |
| | GAA→GGA | E56G | CAA→AAA | Q58K | | | |
| | GAT→AGG | D57R | GCT→ATG | A85M | | | |
| | *AAG→AAA* | *K58K* | ATT→TTG | I86L | | | |
| | GTT→ATT | V60I | CAA→GAT | Q87D | | | |
| | GCA→ATG | A85M | CAA→CAC | Q88H | | | |
| | ATA→TTG | I86L | TTG→ATT | L89I | | | |
| | CAA→GAT | Q87D | TGT→TAC | C90Y | | | |
| | AAA→CAC | K88H | ---→AGA | ---→R91 | | | |
| | TTA→ATT | L89I | ---→GCT | ---→A92 | | | |
| | TGT→TAC | C90Y | ---→GAT | ---→D93 | | | |
| | ---→AGA | ---→R91 | *CCA→CCT* | *P91→P94* | | | |
| | ---→GCT | ---→A92 | ATT→TAT | I92→Y95 | | | |
| | ---→GAT | ---→D93 | CAT→TTT | H93→F96 | | | |
| | *CCA→CCT* | *P91→P94* | ATT→GAG | I94→E97 | | | |
| | ATC→TAT | I92→Y95 | GAT→GCT | D95→A98 | | | |
| | TAT→TTT | Y93→F96 | TCT→CAT | S96→H99 | | | |
| | ATT→GAG | I94→E97 | GAT→GAA | D97→E100 | | | |
| | GAC→GCT | D95→A98 | AAA→TAC | K98→Y101 | | | |
| | AGT→CAT | S96→H99 | GCT→AAT | A99→N102 | | | |
| | AAT→GAA | N97→E100 | *TCA→TCT* | *S174→S177* | | | |
| | AGA→TAC | R98→Y101 | TTG→--- | L175→--- | | | |
| | GCT→AAT | A99→N102 | GTT→--- | V176→--- | | | |
| | AAG→CAA | K125→Q128 | CAA→GCT | Q178→A179 | | | |
| | AAG→CAA | K173→Q176 | GAT→CCA | D179→P180 | | | |
| | *TCA→TCT* | *S174→S177* | GTT→TTG | V181→L182 | | | |
| | TTG→--- | L175→--- | ACT→AAG | T182→K183 | | | |
| | GTA→--- | V176→--- | CCA→TCA | P183→S184 | | | |
| | CAG→GCT | Q178→A179 | AGA→CCT | R184→P185 | | | |

TABLE 33-continued

CVS Variants

| Mutant | Nucleotide changes vs. wildtype | Amino acid changes vs. wildtype | Nucleotide changes vs. CVS V19 | Amino acid changes vs. CVS V19 | SEQ ID NO nt aa | Valencene production % vs. V19 (Shake Flask) |
|---|---|---|---|---|---|---|
| | GAT→CCA | D179→P180 | AGA→TCA | R212→S213 | | |
| | GTA→TTG | V181→L182 | *ATT→ATC* | *I213→I214* | | |
| | ACC→AAG | T182→K183 | GAT→TAT | D214→Y215 | | |
| | CCT→TCA | P183→S184 | TCT→GAC | S215→D216 | | |
| | AAG→CCT | K184→P185 | ACT→AAG | T216→K217 | | |
| | TTT→ATT | F209→I210 | TCT→--- | S217→-- | | |
| | ATG→TCA | M212→S213 | GAT→GAA | D218E | | |
| | AAT→TAT | N214→Y215 | GAT→CAA | D219Q | | |
| | TCA→GAC | S215→D216 | TTG→TCG | L220S | | |
| | ACA→AAG | T216→K217 | GTT→AAG | V221K | | |
| | AGT→--- | S217→-- | *GGT→GGG* | *G276G* | | |
| | GAT→GAA | D218E | CCA→TCA | P281S | | |
| | CAT→CAA | H219Q | TTG→TGC | L313C | | |
| | TTA→TCG | L220S | TCT→ACG | S314T | | |
| | TAC→AAG | Y221K | TTG→ATG | L315M | | |
| | GAG→GAT | E238D | ACC→AGT | T317S | | |
| | AAA→CAA | K252Q | *GAC→GAT* | *D329D* | | |
| | CCT→TCA | P281S | AAG→CGA | K336R | | |
| | CAA→AAA | Q292K | TTA→ATT | L337I | | |
| | CTC→TGC | L313C | GGT→CGG | G357R | | |
| | AGC→ACG | S314T | GAG→GAT | E484D | | |
| | CTC→ATG | L315M | | | | |
| | ACT→AGT | T317S | | | | |
| | CAA→GCT | Q321A | | | | |
| | GAA→GAT | E333D | | | | |
| | AAA→CGA | K336R | | | | |
| | TTG→ATT | L337I | | | | |
| | GCT→ACA | A345T | | | | |
| | GGA→CGG | G357R | | | | |
| | AAT→ATT | N369I | | | | |
| | TCT→TAC | S377Y | | | | |
| | ACA→AGA | T405R | | | | |
| | AAT→GGT | N429G | | | | |
| | GCA→TCT | A436S | | | | |
| | GAA→GAT | E484D | | | | |
| | ACC→CCA | T501P | | | | |
| | GAT→GAA | D536E | | | | |
| V264 | TCG→CAG | S2Q | TCA→CAG | S2Q | 796 853 | ND |
| | TCT→AAT | S3N | TCT→AAT | S3N | | |
| | GGA→CTT | G4L | GGT→CTT | G4L | | |
| | GAA→GGC | E5G | GAA→GGC | E5G | | |
| | ACA→TAC | T6Y | ACT→TAC | T6Y | | |
| | TTT→TCG | F7S | TTT→TCG | F7S | | |
| | AGA→AAA | R19K | AGA→AAA | R19K | | |
| | AAA→CAA | K24Q | ACT→TTA | T53L | | |
| | CAA→AAT | Q38N | GAT→GCA | D54A | | |
| | ACA→TTA | T53L | GCA→ACC | A55T | | |
| | GAT→GCA | D54A | GAA→GGA | E56G | | |
| | GCT→ACC | A55T | GAT→AGG | D57R | | |
| | GAA→GGA | E56G | CAA→AAA | Q58K | | |
| | GAT→AGG | D57R | GCT→ATG | A85M | | |
| | *AAG→AAA* | *K58K* | ATT→TTG | I86L | | |
| | GTT→ATT | V60I | CAA→GAT | Q87D | | |
| | GCA→ATG | A85M | CAA→CAC | Q88H | | |
| | ATA→TTG | I86L | TTG→ATT | L89I | | |
| | CAA→GAT | Q87D | TGT→TAC | C90Y | | |
| | AAA→CAC | K88H | ---→AGA | ---→R91 | | |
| | TTA→ATT | L89I | ---→GCT | ---→A92 | | |
| | TGT→TAC | C90Y | ---→GAT | ---→D93 | | |
| | ---→AGA | ---→R91 | *CCA→CCT* | *P91→P94* | | |
| | ---→GCT | ---→A92 | ATT→TAT | I92→Y95 | | |
| | ---→GAT | ---→D93 | CAT→TTT | H93→F96 | | |
| | *CCA→CCT* | *P91→P94* | ATT→GAG | I94→E97 | | |
| | ATC→TAT | I92→Y95 | GAT→GCT | D95→A98 | | |
| | TAT→TTT | Y93→F96 | TCT→CAT | S96→H99 | | |
| | ATT→GAG | I94→E97 | GAT→GAA | D97→E100 | | |
| | GAC→GCT | D95→A98 | AAA→TAC | K98→Y101 | | |
| | AGT→CAT | S96→H99 | GCT→AAT | A99→N102 | | |
| | AAT→GAA | N97→E100 | *TCA→TCT* | *S174→S177* | | |
| | AGA→TAC | R98→Y101 | TTG→--- | L175→--- | | |

TABLE 33-continued

| CVS Variants | | | | | | |
|---|---|---|---|---|---|---|
| Mutant | Nucleotide changes vs. wildtype | Amino acid changes vs. wildtype | Nucleotide changes vs. CVS V19 | Amino acid changes vs. CVS V19 | SEQ ID NO nt aa | Valencene production % vs. V19 (Shake Flask) |
| | GCT→AAT | A99→N102 | GTT→--- | V176→--- | | |
| | AAG→CAA | K125→Q128 | CAA→GCT | Q178→A179 | | |
| | AAG→CAA | K173→Q176 | GAT→CCA | D179→P180 | | |
| | *TCA→TCT* | *S174→S177* | GTT→TTG | V181→L182 | | |
| | TTG→--- | L175→--- | ACT→AAG | T182→K183 | | |
| | GTA→--- | V176→--- | CCA→TCA | P183→S184 | | |
| | CAG→GCT | Q178→A179 | AGA→CCT | R184→P185 | | |
| | GAT→CCA | D179→P180 | AGA→TCA | R212→S213 | | |
| | GTA→TTG | V181→L182 | *ATT→ATC* | *I213→I214* | | |
| | ACC→AAG | T182→K183 | GAT→TAT | D214→Y215 | | |
| | CCT→TCA | P183→S184 | TCT→GAC | S215→D216 | | |
| | AAG→CCT | K184→P185 | ACT→AAG | T216→K217 | | |
| | TTT→ATT | F209→I210 | TCT→--- | S217→--- | | |
| | ATG→TCA | M212→S213 | GAT→GAA | D218E | | |
| | AAT→TAT | N214→Y215 | GAT→CAA | D219Q | | |
| | TCA→GAC | S215→D216 | TTG→TCG | L220S | | |
| | ACA→AAG | T216→K217 | GTT→AAG | V221K | | |
| | AGT→--- | S217→--- | *GGT→GGG* | *G276G* | | |
| | GAT→GAA | D218E | CCA→TCA | P281S | | |
| | CAT→CAA | H219Q | TTG→TGC | L313C | | |
| | TTA→TCG | L220S | TCT→ACG | S314T | | |
| | TAC→AAG | Y221K | TTG→ATG | L315M | | |
| | GAG→GAT | E238D | ACC→AGT | T317S | | |
| | AAA→CAA | K252Q | *GAC→GAT* | *D329D* | | |
| | CCT→TCA | P281S | AAG→CGA | K336R | | |
| | CAA→AAA | Q292K | TTA→ATT | L337I | | |
| | CTC→TGC | L313C | GGT→CGG | G357R | | |
| | AGC→ACG | S314T | GAG→GAT | E484D | | |
| | CTC→ATG | L315M | | | | |
| | ACT→AGT | T317S | | | | |
| | CAA→GCT | Q321A | | | | |
| | GAA→GAT | E333D | | | | |
| | AAA→CGA | K336R | | | | |
| | TTG→ATT | L337I | | | | |
| | GCT→ACA | A345T | | | | |
| | GGA→CGG | G357R | | | | |
| | AAT→ATT | N369I | | | | |
| | TCT→TAC | S377Y | | | | |
| | ACA→AGA | T405R | | | | |
| | AAT→GGT | N429G | | | | |
| | GCA→TCT | A436S | | | | |
| | GAA→GAT | E484D | | | | |
| | ACC→CCA | T501P | | | | |
| | GAT→GAA | D536E | | | | |
| V265 | TCG→TTA | S2L | TCA→TTA | S2L | 797 854 | ND |
| | TCT→AAC | S3N | TCT→AAC | S3N | | |
| | GGA→TCA | G4S | GGT→TCA | G4S | | |
| | GAA→ATC | E5I | GAA→ATC | E5I | | |
| | ACA→GAT | T6D | ACT→GAT | T6D | | |
| | TTT→TCG | F7S | TTT→TCG | F7S | | |
| | AGA→AAA | R19K | AGA→AAA | R19K | | |
| | AAA→CAA | K24Q | ACT→TTA | T53L | | |
| | CAA→AAT | Q38N | GAT→GCA | D54A | | |
| | ACA→TTA | T53L | GCA→ACC | A55T | | |
| | GAT→GCA | D54A | GAA→GGA | E56G | | |
| | GCT→ACC | A55T | GAT→AGG | D57R | | |
| | GAA→GGA | E56G | CAA→AAA | Q58K | | |
| | GAT→AGG | D57R | GCT→ATG | A85M | | |
| | *AAG→AAA* | *K58K* | ATT→TTG | I86L | | |
| | GTT→ATT | V60I | CAA→GAT | Q87D | | |
| | GCA→ATG | A85M | CAA→CAC | Q88H | | |
| | ATA→TTG | I86L | TTG→ATT | L89I | | |
| | CAA→GAT | Q87D | TGT→TAC | C90Y | | |
| | AAA→CAC | K88H | ---→AGA | ---→R91 | | |
| | TTA→ATT | L89I | ---→GCT | ---→A92 | | |
| | TGT→TAC | C90Y | ---→GAT | ---→D93 | | |
| | ---→AGA | ---→R91 | *CCA→CCT* | *P91→P94* | | |
| | ---→GCT | ---→A92 | ATT→TAT | I92→Y95 | | |
| | ---→GAT | ---→D93 | CAT→TTT | H93→F96 | | |
| | *CCA→CCT* | *P91→P94* | ATT→GAG | I94→E97 | | |

TABLE 33-continued

CVS Variants

| Mutant | Nucleotide changes vs. wildtype | Amino acid changes vs. wildtype | Nucleotide changes vs. CVS V19 | Amino acid changes vs. CVS V19 | SEQ ID NO nt | SEQ ID NO aa | Valencene production % vs. V19 (Shake Flask) |
|---|---|---|---|---|---|---|---|
| | ATC→TAT | I92→Y95 | GAT→GCT | D95→A98 | | | |
| | TAT→TTT | Y93→F96 | TCT→CAT | S96→H99 | | | |
| | ATT→GAG | I94→E97 | GAT→GAA | D97→E100 | | | |
| | GAC→GCT | D95→A98 | AAA→TAC | K98→Y101 | | | |
| | AGT→CAT | S96→H99 | GCT→AAT | A99→N102 | | | |
| | AAT→GAA | N97→E100 | *TCT→TCC* | *S119→S122* | | | |
| | AGA→TAC | R98→Y101 | *TCA→TCT* | *S174→S177* | | | |
| | GCT→AAT | A99→N102 | TTG→--- | L175→--- | | | |
| | *TCA→TCC* | *S119→S122* | GTT→--- | V176→--- | | | |
| | AAG→CAA | K125→Q128 | CAA→GCT | Q178→A179 | | | |
| | AAG→CAA | K173→Q176 | GAT→CCA | D179→P180 | | | |
| | *TCA→TCT* | *S174→S177* | GTT→TTG | V181→L182 | | | |
| | TTG→--- | L175→--- | ACT→AAG | T182→K183 | | | |
| | GTA→--- | V176→--- | CCA→TCA | P183→S184 | | | |
| | CAG→GCT | Q178→A179 | AGA→CCT | R184→P185 | | | |
| | GAT→CCA | D179→P180 | AGA→TCA | R212→S213 | | | |
| | GTA→TTG | V181→L182 | *ATT→ATC* | *I213→I214* | | | |
| | ACC→AAG | T182→K183 | GAT→TAT | D214→Y215 | | | |
| | CCT→TCA | P183→S184 | TCT→GAC | S215→D216 | | | |
| | AAG→CCT | K184→P185 | ACT→AAG | T216→K217 | | | |
| | TTT→ATT | F209→I210 | TCT→--- | S217→--- | | | |
| | ATG→TCA | M212→S213 | GAT→GAA | D218E | | | |
| | AAT→TAT | N214→Y215 | GAT→CAA | D219Q | | | |
| | TCA→GAC | S215→D216 | TTG→TCG | L220S | | | |
| | ACA→AAG | T216→K217 | GTT→AAG | V221K | | | |
| | AGT→--- | S217→--- | *GGT→GGG* | *G276G* | | | |
| | GAT→GAA | D218E | CCA→TCA | P281S | | | |
| | CAT→CAA | H219Q | TTG→TGC | L313C | | | |
| | TTA→TCG | L220S | TCT→ACG | S314T | | | |
| | TAC→AAG | Y221K | TTG→ATG | L315M | | | |
| | GAG→GAT | E238D | ACC→AGT | T317S | | | |
| | AAA→CAA | K252Q | *GAC→GAT* | *D329D* | | | |
| | CCT→TCA | P281S | AAG→CGA | K336R | | | |
| | CAA→AAA | Q292K | TTA→ATT | L337I | | | |
| | CTC→TGC | L313C | GGT→CGG | G357R | | | |
| | AGC→ACG | S314T | GAG→GAT | E484D | | | |
| | CTC→ATG | L315M | | | | | |
| | ACT→AGT | T317S | | | | | |
| | CAA→GCT | Q321A | | | | | |
| | GAA→GAT | E333D | | | | | |
| | AAA→CGA | K336R | | | | | |
| | TTG→ATT | L337I | | | | | |
| | GCT→ACA | A345T | | | | | |
| | GGA→CGG | G357R | | | | | |
| | AAT→ATT | N369I | | | | | |
| | TCT→TAC | S377Y | | | | | |
| | ACA→AGA | T405R | | | | | |
| | AAT→GGT | N429G | | | | | |
| | GCA→TCT | A436S | | | | | |
| | GAA→GAT | E484D | | | | | |
| | ACC→CCA | T501P | | | | | |
| | GAT→GAA | D536E | | | | | |
| V266 | TCG→CCT | S2P | TCA→CCT | S2P | 798 | 855 | ND |
| | TCT→GAC | S3D | TCT→GAC | S3D | | | |
| | GGA→CGC | G4R | GGT→CGC | G4R | | | |
| | GAA→ACC | E5T | GAA→ACC | E5T | | | |
| | ACA→GGA | T6G | ACT→GGA | T6G | | | |
| | TTT→CCA | F7P | TTT→CCA | F7P | | | |
| | AGA→AAA | R19K | AGA→AAA | R19K | | | |
| | AAA→CAA | K24Q | ACT→TTA | T53L | | | |
| | CAA→AAT | Q38N | GAT→GCA | D54A | | | |
| | ACA→TTA | T53L | GCA→ACC | A55T | | | |
| | GAT→GCA | D54A | GAA→GGA | E56G | | | |
| | GCT→ACC | A55T | GAT→AGG | D57R | | | |
| | GAA→GGA | E56G | CAA→AAA | Q58K | | | |
| | GAT→AGG | D57R | GCT→ATG | A85M | | | |
| | *AAG→AAA* | *K58K* | ATT→TTG | I86L | | | |
| | GTT→ATT | V60I | CAA→GAT | Q87D | | | |
| | GCA→ATG | A85M | CAA→CAC | Q88H | | | |
| | ATA→TTG | I86L | TTG→ATT | L89I | | | |

TABLE 33-continued

CVS Variants

| Mutant | Nucleotide changes vs. wildtype | Amino acid changes vs. wildtype | Nucleotide changes vs. CVS V19 | Amino acid changes vs. CVS V19 | SEQ ID NO nt | SEQ ID NO aa | Valencene production % vs. V19 (Shake Flask) |
|---|---|---|---|---|---|---|---|
| | CAA→GAT | Q87D | TGT→TAC | C90Y | | | |
| | AAA→CAC | K88H | ---→AGA | ---→R91 | | | |
| | TTA→ATT | L89I | ---→GCT | ---→A92 | | | |
| | TGT→TAC | C90Y | ---→GAT | ---→D93 | | | |
| | ---→AGA | ---→R91 | *CCA→CCT* | *P91→P94* | | | |
| | ---→GCT | ---→A92 | ATT→TAT | I92→Y95 | | | |
| | ---→GAT | ---→D93 | CAT→TTT | H93→F96 | | | |
| | *CCA→CCT* | *P91→P94* | ATT→GAG | I94→E97 | | | |
| | ATC→TAT | I92→Y95 | GAT→GCT | D95→A98 | | | |
| | TAT→TTT | Y93→F96 | TCT→CAT | S96→H99 | | | |
| | ATT→GAG | I94→E97 | GAT→GAA | D97→E100 | | | |
| | GAC→GCT | D95→A98 | AAA→TAC | K98→Y101 | | | |
| | AGT→CAT | S96→H99 | GCT→AAT | A99→N102 | | | |
| | AAT→GAA | N97→E100 | *TCA→TCT* | *S174→S177* | | | |
| | AGA→TAC | R98→Y101 | TTG→--- | L175→--- | | | |
| | GCT→AAT | A99→N102 | GTT→--- | V176→--- | | | |
| | AAG→CAA | K125→Q128 | CAA→GCT | Q178→A179 | | | |
| | AAG→CAA | K173→Q176 | GAT→CCA | D179→P180 | | | |
| | *TCA→TCT* | *S174→S177* | GTT→TTG | V181→L182 | | | |
| | TTG→--- | L175→--- | ACT→AAG | T182→K183 | | | |
| | GTA→--- | V176→--- | CCA→TCA | P183→S184 | | | |
| | CAG→GCT | Q178→A179 | AGA→CCT | R184→P185 | | | |
| | GAT→CCA | D179→P180 | AGA→TCA | R212→S213 | | | |
| | GTA→TTG | V181→L182 | *ATT→ATC* | *I213→I214* | | | |
| | ACC→AAG | T182→K183 | GAT→TAT | D214→Y215 | | | |
| | CCT→TCA | P183→S184 | TCT→GAC | S215→D216 | | | |
| | AAG→CCT | K184→P185 | ACT→AAG | T216→K217 | | | |
| | TTT→ATT | F209→I210 | TCT→--- | S217→-- | | | |
| | ATG→TCA | M212→S213 | GAT→GAA | D218E | | | |
| | AAT→TAT | N214→Y215 | GAT→CAA | D219Q | | | |
| | TCA→GAC | S215→D216 | TTG→TCG | L220S | | | |
| | ACA→AAG | T216→K217 | GTT→AAG | V221K | | | |
| | AGT→--- | S217→--- | *GGT→GGG* | *G276G* | | | |
| | GAT→GAA | D218E | CCA→TCA | P281S | | | |
| | CAT→CAA | H219Q | TTG→TGC | L313C | | | |
| | TTA→TCG | L220S | TCT→ACG | S314T | | | |
| | TAC→AAG | Y221K | TTG→ATG | L315M | | | |
| | GAG→GAT | E238D | ACC→AGT | T317S | | | |
| | AAA→CAA | K252Q | *GAC→GAT* | *D329D* | | | |
| | CCT→TCA | P281S | AAG→CGA | K336R | | | |
| | CAA→AAA | Q292K | TTA→ATT | L337I | | | |
| | CTC→TGC | L313C | GGT→CGG | G357R | | | |
| | AGC→ACG | S314T | GAG→GAT | E484D | | | |
| | CTC→ATG | L315M | | | | | |
| | ACT→AGT | T317S | | | | | |
| | CAA→GCT | Q321A | | | | | |
| | GAA→GAT | E333D | | | | | |
| | AAA→CGA | K336R | | | | | |
| | TTG→ATT | L337I | | | | | |
| | GCT→ACA | A345T | | | | | |
| | GGA→CGG | G357R | | | | | |
| | AAT→ATT | N369I | | | | | |
| | TCT→TAC | S377Y | | | | | |
| | ACA→AGA | T405R | | | | | |
| | AAT→GGT | N429G | | | | | |
| | GCA→TCT | A436S | | | | | |
| | GAA→GAT | E484D | | | | | |
| | ACC→CCA | T501P | | | | | |
| | GAT→GAA | D536E | | | | | |
| V273 | TCG→GCA | S2A | TCA→GCA | S2A | 806 | 863 | ND |
| | TCT→ACT | S3T | TCT→ACT | S3T | | | |
| | GGA→TCT | G4S | GGT→TCT | G4S | | | |
| | GAA→CAC | E5H | GAA→CAC | E5H | | | |
| | ACA→AGT | T6S | ACT→AGT | T6S | | | |
| | TTT→CAG | F7Q | TTT→CAG | F7Q | | | |
| | AGA→AAA | R19K | AGA→AAA | R19K | | | |
| | AAA→CAA | K24Q | ACT→TTA | T53L | | | |
| | CAA→AAT | Q38N | GAT→GCA | D54A | | | |
| | ACA→TTA | T53L | GCA→ACC | A55T | | | |
| | GAT→GCA | D54A | GAA→GGA | E56G | | | |

TABLE 33-continued

| CVS Variants | | | | | | | |
|---|---|---|---|---|---|---|---|
| Mutant | Nucleotide changes vs. wildtype | Amino acid changes vs. wildtype | Nucleotide changes vs. CVS V19 | Amino acid changes vs. CVS V19 | SEQ ID NO nt | SEQ ID NO aa | Valencene production % vs. V19 (Shake Flask) |
| | GCT→ACC | A55T | GAT→AGG | D57R | | | |
| | GAA→GGA | E56G | CAA→AAA | Q58K | | | |
| | GAT→AGG | D57R | GCT→ATG | A85M | | | |
| | *AAG→AAA* | *K58K* | ATT→TTG | I86L | | | |
| | GTT→ATT | V60I | CAA→GAT | Q87D | | | |
| | GCA→ATG | A85M | CAA→CAC | Q88H | | | |
| | ATA→TTG | I86L | TTG→ATT | L89I | | | |
| | CAA→GAT | Q87D | TGT→TAC | C90Y | | | |
| | AAA→CAC | K88H | ---→AGA | ---→R91 | | | |
| | TTA→ATT | L89I | ---→GCT | ---→A92 | | | |
| | TGT→TAC | C90Y | ---→GAT | ---→D93 | | | |
| | ---→AGA | ---→R91 | *CCA→CCT* | *P91→P94* | | | |
| | ---→GCT | ---→A92 | ATT→TAT | I92→Y95 | | | |
| | ---→GAT | ---→D93 | CAT→TTT | H93→F96 | | | |
| | *CCA→CCT* | *P91→P94* | ATT→GAG | I94→E97 | | | |
| | ATC→TAT | I92→Y95 | GAT→GCT | D95→A98 | | | |
| | TAT→TTT | Y93→F96 | TCT→CAT | S96→H99 | | | |
| | ATT→GAG | I94→E97 | GAT→GAA | D97→E100 | | | |
| | GAC→GCT | D95→A98 | AAA→TAC | K98→Y101 | | | |
| | AGT→CAT | S96→H99 | GCT→AAT | A99→N102 | | | |
| | AAT→GAA | N97→E100 | *TCA→TCT* | *S174→S177* | | | |
| | AGA→TAC | R98→Y101 | TTG→--- | L175→--- | | | |
| | GCT→AAT | A99→N102 | GTT→--- | V176→--- | | | |
| | AAG→CAA | K125→Q128 | CAA→GCT | Q178→A179 | | | |
| | AAG→CAA | K173→Q176 | GAT→CCA | D179→P180 | | | |
| | *TCA→TCT* | *S174→S177* | GTT→TTG | V181→L182 | | | |
| | TTG→--- | L175→--- | ACT→AAG | T182→K183 | | | |
| | GTA→--- | V176→--- | CCA→TCA | P183→S184 | | | |
| | CAG→GCT | Q178→A179 | AGA→CCT | R184→P185 | | | |
| | GAT→CCA | D179→P180 | AGA→TCA | R212→S213 | | | |
| | GTA→TTG | V181→L182 | *ATT→ATC* | *I213→I214* | | | |
| | ACC→AAG | T182→K183 | GAT→TAT | D214→Y215 | | | |
| | CCT→TCA | P183→S184 | TCT→GAC | S215→D216 | | | |
| | AAG→CCT | K184→P185 | ACT→AAG | T216→K217 | | | |
| | TTT→ATT | F209→I210 | TCT→--- | S217→-- | | | |
| | ATG→TCA | M212→S213 | GAT→GAA | D218E | | | |
| | AAT→TAT | N214→Y215 | GAT→CAA | D219Q | | | |
| | TCA→GAC | S215→D216 | TTG→TCG | L220S | | | |
| | ACA→AAG | T216→K217 | GTT→AAG | V221K | | | |
| | AGT→--- | S217→--- | *GGT→GGG* | *G276G* | | | |
| | GAT→GAA | D218E | CCA→TCA | P281S | | | |
| | CAT→CAA | H219Q | TTG→TGC | L313C | | | |
| | TTA→TCG | L220S | TCT→ACG | S314T | | | |
| | TAC→AAG | Y221K | TTG→ATG | L315M | | | |
| | GAG→GAT | E238D | ACC→AGT | T317S | | | |
| | AAA→CAA | K252Q | ATT→ACT | I325T | | | |
| | CCT→TCA | P281S | *GAC→GAT* | *D329D* | | | |
| | CAA→AAA | Q292K | AAG→CGA | K336R | | | |
| | CTC→TGC | L313C | TTA→ATT | L337I | | | |
| | AGC→ACG | S314T | GGT→CGG | G357R | | | |
| | CTC→ATG | L315M | *GGT→GGA* | *G414G* | | | |
| | ACT→AGT | T317S | GAG→GAT | E484D | | | |
| | CAA→GCT | Q321A | | | | | |
| | ATT→ACT | I325T | | | | | |
| | GAA→GAT | E333D | | | | | |
| | AAA→CGA | K336R | | | | | |
| | TTG→ATT | L337I | | | | | |
| | GCT→ACA | A345T | | | | | |
| | GGA→CGG | G357R | | | | | |
| | AAT→ATT | N369I | | | | | |
| | TCT→TAC | S377Y | | | | | |
| | ACA→AGA | T405R | | | | | |
| | *GGC→GGA* | *G414G* | | | | | |
| | AAT→GGT | N429G | | | | | |
| | GCA→TCT | A436S | | | | | |
| | GAA→GAT | E484D | | | | | |
| | ACC→CCA | T501P | | | | | |
| | GAT→GAA | D536E | | | | | |

h. V267, V268, V269, V270 and V271

In CVS variants V267, V268, V269, V270 and V271, amino acids 53-58 were replaced by amino acids 58-63 of TEAS (SEQ ID NO:941), amino acids 85-99 were replaced by amino acids 93-110 of HPS (SEQ ID NO:942) and amino acids 174-184 were replaced by amino acids 185-193 of HPS (SEQ ID NO:942) or 177-185 of TEAS (SEQ ID NO:941) as described above. These variants additionally contain random mutations at L106 (V267), or F209 (V268-V271). CVS variants V267, V268, V269, V270 and V271 were generated using V240 as a template, with primers set forth in Table 25 above. The variants, including amino acid and nucleotide changes versus both wildtype CVS and CVS V19, and valencene production % versus CVS V19 are set forth in Table 34 below.

TABLE 34

| CVS Variants | | | | | | | |
|---|---|---|---|---|---|---|---|
| Mutant | Nucleotide changes vs. wildtype | Amino acid changes vs. wildtype | Nucleotide changes vs. CVS V19 | Amino acid changes vs. CVS V19 | SEQ ID NO nt | SEQ ID NO aa | Valencene production % vs. V19 (Shake Flask) |
| V267 | AGA→AAA | R19K | AGA→AAA | R19K | 799 | 856 | |
| | AAA→CAA | K24Q | ACT→TTA | T53L | | | |
| | CAA→AAT | Q38N | GAT→GCA | D54A | | | |
| | ACA→TTA | T53L | GCA→ACC | A55T | | | |
| | GAT→GCA | D54A | GAA→GGA | E56G | | | |
| | GCT→ACC | A55T | GAT→AGG | D57R | | | |
| | GAA→GGA | E56G | CAA→AAA | Q58K | | | |
| | GAT→AGG | D57R | GCT→ATG | A85M | | | |
| | *AAG→AAA* | *K58K* | ATT→TTG | I86L | | | |
| | GTT→ATT | V60I | CAA→GAT | Q87D | | | |
| | GCA→ATG | A85M | CAA→CAC | Q88H | | | |
| | ATA→TTG | I86L | TTG→ATT | L89I | | | |
| | CAA→GAT | Q87D | TGT→TAC | C90Y | | | |
| | AAA→CAC | K88H | ---→AGA | ---→R91 | | | |
| | TTA→ATT | L89I | ---→GCT | ---→A92 | | | |
| | TGT→TAC | C90Y | ---→GAT | ---→D93 | | | |
| | ---→AGA | ---→R91 | *CCA→CCT* | *P91→P94* | | | |
| | ---→GCT | ---→A92 | ATT→TAT | I92→Y95 | | | |
| | ---→GAT | ---→D93 | CAT→TTT | H93→F96 | | | |
| | *CCA→CCT* | *P91→P94* | ATT→GAG | I94→E97 | | | |
| | ATC→TAT | I92→Y95 | GAT→GCT | D95→A98 | | | |
| | TAT→TTT | Y93→F96 | TCT→CAT | S96→H99 | | | |
| | ATT→GAG | I94→E97 | GAT→GAA | D97→E100 | | | |
| | GAC→GCT | D95→A98 | AAA→TAC | K98→Y101 | | | |
| | AGT→CAT | S96→H99 | GCT→AAT | A99→N102 | | | |
| | AAT→GAA | N97→E100 | *TTG→CTT* | *L106→L109* | | | |
| | AGA→TAC | R98→Y101 | *TCA→TCT* | *S174→S177* | | | |
| | GCT→AAT | A99→N102 | TTG→--- | L175→--- | | | |
| | AAG→CAA | K125→Q128 | GTT→--- | V176→--- | | | |
| | AAG→CAA | K173→Q176 | CAA→GCT | Q178→A179 | | | |
| | *TCA→TCT* | *S174→S177* | GAT→CCA | D179→P180 | | | |
| | TTG→--- | L175→--- | GTT→TTG | V181→L182 | | | |
| | GTA→--- | V176→--- | ACT→AAG | T182→K183 | | | |
| | CAG→GCT | Q178→A179 | CCA→TCA | P183→S184 | | | |
| | GAT→CCA | D179→P180 | AGA→CCT | R184→P185 | | | |
| | GTA→TTG | V181→L182 | *GGT→GGG* | *G276→G277* | | | |
| | ACC→AAG | T182→K183 | CCA→TCA | P281→S282 | | | |
| | CCT→TCA | P183→S184 | TTG→TGC | L313→C314 | | | |
| | AAG→CCT | K184→P185 | TCT→ACG | S314→T315 | | | |
| | TTT→ATT | F209→I210 | TTG→ATG | L315→M316 | | | |
| | ATG→AGA | M212→R213 | ACC→AGT | T317→S318 | | | |
| | AAT→GAT | N214→D215 | *GAC→GAT* | *D329→D330* | | | |
| | CAT→GAT | H219→D220 | AAG→CGA | K336→R337 | | | |
| | TAC→GTT | Y221→V222 | TTA→ATT | L337→I338 | | | |
| | GAG→GAT | E238→D239 | GGT→CGG | G357→R358 | | | |
| | AAA→CAA | K252→Q253 | GAG→GAT | E484→D485 | | | |
| | CCT→TCA | P281→S282 | | | | | |
| | CAA→AAA | Q292→K293 | | | | | |
| | CTC→TGC | L313→C314 | | | | | |
| | AGC→ACG | S314→T315 | | | | | |
| | CTC→ATG | L315→M316 | | | | | |
| | ACT→AGT | T317→S318 | | | | | |
| | CAA→GCT | Q321→A322 | | | | | |
| | GAA→GAT | E333→D334 | | | | | |
| | AAA→CGA | K336→R337 | | | | | |
| | TTG→ATT | L337→I338 | | | | | |
| | GCT→ACA | A345→T346 | | | | | |
| | GGA→CGG | G357→R358 | | | | | |
| | AAT→ATT | N369→I370 | | | | | |
| | TCT→TAC | S377→Y378 | | | | | |

TABLE 34-continued

| CVS Variants | | | | | | | |
|---|---|---|---|---|---|---|---|
| Mutant | Nucleotide changes vs. wildtype | Amino acid changes vs. wildtype | Nucleotide changes vs. CVS V19 | Amino acid changes vs. CVS V19 | SEQ ID NO nt | SEQ ID NO aa | Valencene production % vs. V19 (Shake Flask) |
| | ACA→AGA | T405→R406 | | | | | |
| | AAT→GGT | N429→G430 | | | | | |
| | GCA→TCT | A436→S437 | | | | | |
| | GAA→GAT | E484→D485 | | | | | |
| | ACC→CCA | T501→P502 | | | | | |
| | GAT→GAA | D536→E537 | | | | | |
| V268 | AGA→AAA | R19K | AGA→AAA | R19K | 801 | 858 | 93 |
| | AAA→CAA | K24Q | ACT→TTA | T53L | | | |
| | CAA→AAT | Q38N | GAT→GCA | D54A | | | |
| | ACA→TTA | T53L | GCA→ACC | A55T | | | |
| | GAT→GCA | D54A | GAA→GGA | E56G | | | |
| | GCT→ACC | A55T | GAT→AGG | D57R | | | |
| | GAA→GGA | E56G | CAA→AAA | Q58K | | | |
| | GAT→AGG | D57R | GCT→ATG | A85M | | | |
| | *AAG→AAA* | *K58K* | ATT→TTG | I86L | | | |
| | GTT→ATT | V60I | CAA→GAT | Q87D | | | |
| | GCA→ATG | A85M | CAA→CAC | Q88H | | | |
| | ATA→TTG | I86L | TTG→ATT | L89I | | | |
| | CAA→GAT | Q87D | TGT→TAC | C90Y | | | |
| | AAA→CAC | K88H | ---→AGA | ---→R91 | | | |
| | TTA→ATT | L89I | ---→GCT | ---→A92 | | | |
| | TGT→TAC | C90Y | ---→GAT | ---→D93 | | | |
| | ---→AGA | ---→R91 | *CCA→CCT* | *P91→P94* | | | |
| | ---→GCT | ---→A92 | ATT→TAT | I92→Y95 | | | |
| | ---→GAT | ---→D93 | CAT→TTT | H93→F96 | | | |
| | *CCA→CCT* | *P91→P94* | ATT→GAG | I94→E97 | | | |
| | ATC→TAT | I92→Y95 | GAT→GCT | D95→A98 | | | |
| | TAT→TTT | Y93→F96 | TCT→CAT | S96→H99 | | | |
| | ATT→GAG | I94→E97 | GAT→GAA | D97→E100 | | | |
| | GAC→GCT | D95→A98 | AAA→TAC | K98→Y101 | | | |
| | AGT→CAT | S96→H99 | GCT→AAT | A99→N102 | | | |
| | AAT→GAA | N97→E100 | *TCA→TCT* | *S174→S177* | | | |
| | AGA→TAC | R98→Y101 | TTG→--- | L175→--- | | | |
| | GCT→AAT | A99→N102 | GTT→--- | V176→--- | | | |
| | AAG→CAA | K125→Q128 | CAA→GCT | Q178→A179 | | | |
| | AAG→CAA | K173→Q176 | GAT→CCA | D179→P180 | | | |
| | *TCA→TCT* | *S174→S177* | GTT→TTG | V181→L182 | | | |
| | TTG→--- | L175→--- | ACT→AAG | T182→K183 | | | |
| | GTA→--- | V176→--- | CCA→TCA | P183→S184 | | | |
| | CAG→GCT | Q178→A179 | AGA→CCT | R184→P185 | | | |
| | GAT→CCA | D179→P180 | ATT→GAG | I209→E210 | | | |
| | GTA→TTG | V181→L182 | *GGT→GGG* | *G276→G277* | | | |
| | ACC→AAG | T182→K183 | CCA→TCA | P281→S282 | | | |
| | CCT→TCA | P183→S184 | TTG→TGC | L313→C314 | | | |
| | AAG→CCT | K184→P185 | TCT→ACG | S314→T315 | | | |
| | TTT→GAG | F209→E210 | TTG→ATG | L315→M316 | | | |
| | ATG→AGA | M212→R213 | ACC→AGT | T317→S318 | | | |
| | AAT→GAT | N214→D215 | *GAC→GAT* | *D329→D330* | | | |
| | CAT→GAT | H219→D220 | AAG→CGA | K336→R337 | | | |
| | TAC→GTT | Y221→V222 | TTA→ATT | L337→I338 | | | |
| | GAG→GAT | E238→D239 | GGT→CGG | G357→R358 | | | |
| | AAA→CAA | K252→Q253 | GAG→GAT | E484→D485 | | | |
| | CCT→TCA | P281→S282 | | | | | |
| | CAA→AAA | Q292→K293 | | | | | |
| | CTC→TGC | L313→C314 | | | | | |
| | AGC→ACG | S314→T315 | | | | | |
| | CTC→ATG | L315→M316 | | | | | |
| | ACT→AGT | T317→S318 | | | | | |
| | CAA→GCT | Q321→A322 | | | | | |
| | GAA→GAT | E333→D334 | | | | | |
| | AAA→CGA | K336→R337 | | | | | |
| | TTG→ATT | L337→I338 | | | | | |
| | GCT→ACA | A345→T346 | | | | | |
| | GGA→CGG | G357→R358 | | | | | |
| | AAT→ATT | N369→I370 | | | | | |
| | TCT→TAC | S377→Y378 | | | | | |
| | ACA→AGA | T405→R406 | | | | | |
| | AAT→GGT | N429→G430 | | | | | |
| | GCA→TCT | A436→S437 | | | | | |
| | GAA→GAT | E484→D485 | | | | | |

TABLE 34-continued

| CVS Variants | | | | | | | |
|---|---|---|---|---|---|---|---|
| Mutant | Nucleotide changes vs. wildtype | Amino acid changes vs. wildtype | Nucleotide changes vs. CVS V19 | Amino acid changes vs. CVS V19 | SEQ ID NO nt | SEQ ID NO aa | Valencene production % vs. V19 (Shake Flask) |
| | ACC→CCA | T501→P502 | | | | | |
| | GAT→GAA | D536→E537 | | | | | |
| V269 | AAA→CAA | K24Q | ACT→TTA | T53L | 802 | 859 | 99.9 |
| | CAA→AAT | Q38N | GAT→GCA | D54A | | | |
| | ACA→TTA | T53L | GCA→ACC | A55T | | | |
| | GAT→GCA | D54A | GAA→GGA | E56G | | | |
| | GCT→ACC | A55T | GAT→AGG | D57R | | | |
| | GAA→GGA | E56G | CAA→AAA | Q58K | | | |
| | GAT→AGG | D57R | *TTG→TTA* | *L72L* | | | |
| | *AAG→AAA* | *K58K* | GCT→ATG | A85M | | | |
| | GTT→ATT | V60I | ATT→TTG | I86L | | | |
| | *CTG→TTA* | *L72L* | CAA→GAT | Q87D | | | |
| | GCA→ATG | A85M | CAA→CAC | Q88H | | | |
| | ATA→TTG | I86L | TTG→ATT | L89I | | | |
| | CAA→GAT | Q87D | TGT→TAC | C90Y | | | |
| | AAA→CAC | K88H | ---→AGA | ---→R91 | | | |
| | TTA→ATT | L89I | ---→GCT | ---→A92 | | | |
| | TGT→TAC | C90Y | ---→GAT | ---→D93 | | | |
| | ---→AGA | ---→R91 | *CCA→CCT* | *P91→P94* | | | |
| | ---→GCT | ---→A92 | ATT→TAT | I92→Y95 | | | |
| | ---→GAT | ---→D93 | CAT→TTT | H93→F96 | | | |
| | *CCA→CCT* | *P91→P94* | ATT→GAG | I94→E97 | | | |
| | ATC→TAT | I92→Y95 | GAT→GCT | D95→A98 | | | |
| | TAT→TTT | Y93→F96 | TCT→CAT | S96→H99 | | | |
| | ATT→GAG | I94→E97 | GAT→GAA | D97→E100 | | | |
| | GAC→GCT | D95→A98 | AAA→TAC | K98→Y101 | | | |
| | AGT→CAT | S96→H99 | GCT→AAT | A99→N102 | | | |
| | AAT→GAA | N97→E100 | TTG→TCG | L111→S114 | | | |
| | AGA→TAC | R98→Y101 | *TCA→TCT* | *S174→S177* | | | |
| | GCT→AAT | A99→N102 | TTG→--- | L175→--- | | | |
| | CTT→TCG | L111→S114 | GTT→--- | V176→--- | | | |
| | AAG→CAA | K125→Q128 | CAA→GCT | Q178→A179 | | | |
| | AAG→CAA | K173→Q176 | GAT→CCA | D179→P180 | | | |
| | *TCA→TCT* | *S174→S177* | GTT→TTG | V181→L182 | | | |
| | TTG→--- | L175→--- | ACT→AAG | T182→K183 | | | |
| | GTA→--- | V176→--- | CCA→TCA | P183→S184 | | | |
| | CAG→GCT | Q178→A179 | AGA→CCT | R184→P185 | | | |
| | GAT→CCA | D179→P180 | ATT→GAA | I209→E210 | | | |
| | GTA→TTG | V181→L182 | *GGT→GGG* | *G276→G277* | | | |
| | ACC→AAG | T182→K183 | CCA→TCA | P281→S282 | | | |
| | CCT→TCA | P183→S184 | TTG→TGC | L313→C314 | | | |
| | AAG→CCT | K184→P185 | TCT→ACG | S314→T315 | | | |
| | TTT→GAA | F209→E210 | TTG→ATG | L315→M316 | | | |
| | ATG→AGA | M212→R213 | ACC→AGT | T317→S318 | | | |
| | AAT→GAT | N214→D215 | *GAC→GAT* | *D329→D330* | | | |
| | CAT→GAT | H219→D220 | AAG→CGA | K336→R337 | | | |
| | TAC→GTT | Y221→V222 | TTA→ATT | L337→I338 | | | |
| | GAG→GAT | E238→D239 | GGT→CGG | G357→R358 | | | |
| | AAA→CAA | K252→Q253 | GAG→GAT | E484→D485 | | | |
| | CCT→TCA | P281→S282 | | | | | |
| | CAA→AAA | Q292→K293 | | | | | |
| | CTC→TGC | L313→C314 | | | | | |
| | AGC→ACG | S314→T315 | | | | | |
| | CTC→ATG | L315→M316 | | | | | |
| | ACT→AGT | T317→S318 | | | | | |
| | CAA→GCT | Q321→A322 | | | | | |
| | GAA→GAT | E333→D334 | | | | | |
| | AAA→CGA | K336→R337 | | | | | |
| | TTG→ATT | L337→I338 | | | | | |
| | GCT→ACA | A345→T346 | | | | | |
| | GGA→CGG | G357→R358 | | | | | |
| | AAT→ATT | N369→I370 | | | | | |
| | TCT→TAC | S377→Y378 | | | | | |
| | ACA→AGA | T405→R406 | | | | | |
| | AAT→GGT | N429→G430 | | | | | |
| | GCA→TCT | A436→S437 | | | | | |
| | GAA→GAT | E484→D485 | | | | | |
| | ACC→CCA | T501→P502 | | | | | |
| | GAT→GAA | D536→E537 | | | | | |

TABLE 34-continued

| CVS Variants | | | | | | | |
|---|---|---|---|---|---|---|---|
| Mutant | Nucleotide changes vs. wildtype | Amino acid changes vs. wildtype | Nucleotide changes vs. CVS V19 | Amino acid changes vs. CVS V19 | SEQ ID NO nt | SEQ ID NO aa | Valencene production % vs. V19 (Shake Flask) |
| V270 | AGA→AAA | R19K | AGA→AAA | R19K | 803 | 860 | 88.5 |
| | AAA→CAA | K24Q | ACT→TTA | T53L | | | |
| | CAA→AAT | Q38N | GAT→GCA | D54A | | | |
| | ACA→TTA | T53L | GCA→ACC | A55T | | | |
| | GAT→GCA | D54A | GAA→GGA | E56G | | | |
| | GCT→ACC | A55T | GAT→AGG | D57R | | | |
| | GAA→GGA | E56G | CAA→AAA | Q58K | | | |
| | GAT→AGG | D57R | GCT→ATG | A85M | | | |
| | *AAG→AAA* | *K58K* | ATT→TTG | I86L | | | |
| | GTT→ATT | V60I | CAA→GAT | Q87D | | | |
| | GCA→ATG | A85M | CAA→CAC | Q88H | | | |
| | ATA→TTG | I86L | TTG→ATT | L89I | | | |
| | CAA→GAT | Q87D | TGT→TAC | C90Y | | | |
| | AAA→CAC | K88H | ---→AGA | ---→R91 | | | |
| | TTA→ATT | L89I | ---→GCT | ---→A92 | | | |
| | TGT→TAC | C90Y | ---→GAT | ---→D93 | | | |
| | ---→AGA | ---→R91 | *CCA→CCT* | *P91→P94* | | | |
| | ---→GCT | ---→A92 | ATT→TAT | I92→Y95 | | | |
| | ---→GAT | ---→D93 | CAT→TTT | H93→F96 | | | |
| | *CCA→CCT* | *P91→P94* | ATT→GAG | I94→E97 | | | |
| | ATC→TAT | I92→Y95 | GAT→GCT | D95→A98 | | | |
| | TAT→TTT | Y93→F96 | TCT→CAT | S96→H99 | | | |
| | ATT→GAG | I94→E97 | GAT→GAA | D97→E100 | | | |
| | GAC→GCT | D95→A98 | AAA→TAC | K98→Y101 | | | |
| | AGT→CAT | S96→H99 | GCT→AAT | A99→N102 | | | |
| | AAT→GAA | N97→E100 | *TCA→TCT* | *S174→S177* | | | |
| | AGA→TAC | R98→Y101 | TTG→--- | L175→--- | | | |
| | GCT→AAT | A99→N102 | GTT→--- | V176→--- | | | |
| | AAG→CAA | K125→Q128 | CAA→GCT | Q178→A179 | | | |
| | AAG→CAA | K173→Q176 | GAT→CCA | D179→P180 | | | |
| | *TCA→TCT* | *S174→S177* | GTT→TTG | V181→L182 | | | |
| | TTG→--- | L175→--- | ACT→AAG | T182→K183 | | | |
| | GTA→--- | V176→--- | CCA→TCA | P183→S184 | | | |
| | CAG→GCT | Q178→A179 | AGA→CCT | R184→P185 | | | |
| | GAT→CCA | D179→P180 | ATT→TTA | I209→L210 | | | |
| | GTA→TTG | V181→L182 | *GGT→GGG* | *G276→G277* | | | |
| | ACC→AAG | T182→K183 | CCA→TCA | P281→S282 | | | |
| | CCT→TCA | P183→S184 | TTG→TGC | L313→C314 | | | |
| | AAG→CCT | K184→P185 | TCT→ACG | S314→T315 | | | |
| | TTT→TTA | F209→L210 | TTG→ATG | L315→M316 | | | |
| | ATG→AGA | M212→R213 | ACC→AGT | T317→S318 | | | |
| | AAT→GAT | N214→D215 | *GAC→GAT* | *D329→D330* | | | |
| | CAT→GAT | H219→D220 | AAG→CGA | K336→R337 | | | |
| | TAC→GTT | Y221→V222 | TTA→ATT | L337→I338 | | | |
| | GAG→GAT | E238→D239 | GGT→CGG | G357→R358 | | | |
| | AAA→CAA | K252→Q253 | GAG→GAT | E484→D485 | | | |
| | CCT→TCA | P281→S282 | | | | | |
| | CAA→AAA | Q292→K293 | | | | | |
| | CTC→TGC | L313→C314 | | | | | |
| | AGC→ACG | S314→T315 | | | | | |
| | CTC→ATG | L315→M316 | | | | | |
| | ACT→AGT | T317→S318 | | | | | |
| | CAA→GCT | Q321→A322 | | | | | |
| | GAA→GAT | E333→D334 | | | | | |
| | AAA→CGA | K336→R337 | | | | | |
| | TTG→ATT | L337→I338 | | | | | |
| | GCT→ACA | A345→T346 | | | | | |
| | GGA→CGG | G357→R358 | | | | | |
| | AAT→ATT | N369→I370 | | | | | |
| | TCT→TAC | S377→Y378 | | | | | |
| | ACA→AGA | T405→R406 | | | | | |
| | AAT→GGT | N429→G430 | | | | | |
| | GCA→TCT | A436→S437 | | | | | |
| | GAA→GAT | E484→D485 | | | | | |
| | ACC→CCA | T501→P502 | | | | | |
| | GAT→GAA | D536→E537 | | | | | |
| V271 | AGA→AAA | R19K | AGA→AAA | R19K | 804 | 861 | 93 |
| | AAA→CAA | K24Q | ACT→TTA | T53L | | | |
| | CAA→AAT | Q38N | GAT→GCA | D54A | | | |
| | ACA→TTA | T53L | GCA→ACC | A55T | | | |

TABLE 34-continued

CVS Variants

| Mutant | Nucleotide changes vs. wildtype | Amino acid changes vs. wildtype | Nucleotide changes vs. CVS V19 | Amino acid changes vs. CVS V19 | SEQ ID NO nt | SEQ ID NO aa | Valencene production % vs. V19 (Shake Flask) |
|---|---|---|---|---|---|---|---|
| | GAT→GCA | D54A | GAA→GGA | E56G | | | |
| | GCT→ACC | A55T | GAT→AGG | D57R | | | |
| | GAA→GGA | E56G | CAA→AAA | Q58K | | | |
| | GAT→AGG | D57R | GCT→ATG | A85M | | | |
| | *AAG→AAA* | *K58K* | ATT→TTG | I86L | | | |
| | GTT→ATT | V60I | CAA→GAT | Q87D | | | |
| | GCA→ATG | A85M | CAA→CAC | Q88H | | | |
| | ATA→TTG | I86L | TTG→ATT | L89I | | | |
| | CAA→GAT | Q87D | TGT→TAC | C90Y | | | |
| | AAA→CAC | K88H | ---→AGA | ---→R91 | | | |
| | TTA→ATT | L89I | ---→GCT | ---→A92 | | | |
| | TGT→TAC | C90Y | ---→GAT | ---→D93 | | | |
| | ---→AGA | ---→R91 | *CCA→CCT* | *P91→P94* | | | |
| | ---→GCT | ---→A92 | ATT→TAT | I92→Y95 | | | |
| | ---→GAT | ---→D93 | CAT→TTT | H93→F96 | | | |
| | *CCA→CCT* | *P91→P94* | ATT→GAG | I94→E97 | | | |
| | ATC→TAT | I92→Y95 | GAT→GCT | D95→A98 | | | |
| | TAT→TTT | Y93→F96 | TCT→CAT | S96→H99 | | | |
| | ATT→GAG | I94→E97 | GAT→GAA | D97→E100 | | | |
| | GAC→GCT | D95→A98 | AAA→TAC | K98→Y101 | | | |
| | AGT→CAT | S96→H99 | GCT→AAT | A99→N102 | | | |
| | AAT→GAA | N97→E100 | *TCA→TCT* | *S174→S177* | | | |
| | AGA→TAC | R98→Y101 | TTG→--- | L175→--- | | | |
| | GCT→AAT | A99→N102 | GTT→--- | V176→--- | | | |
| | AAG→CAA | K125→Q128 | CAA→GCT | Q178→A179 | | | |
| | AAG→CAA | K173→Q176 | GAT→CCA | D179→P180 | | | |
| | *TCA→TCT* | *S174→S177* | GTT→TTG | V181→L182 | | | |
| | TTG→--- | L175→--- | ACT→AAG | T182→K183 | | | |
| | GTA→--- | V176→--- | CCA→TCA | P183→S184 | | | |
| | CAG→GCT | Q178→A179 | AGA→CCT | R184→P185 | | | |
| | GAT→CCA | D179→P180 | ATT→ACG | I209→T210 | | | |
| | GTA→TTG | V181→L182 | *GGT→GGG* | *G276→G277* | | | |
| | ACC→AAG | T182→K183 | CCA→TCA | P281→S282 | | | |
| | CCT→TCA | P183→S184 | TTG→TGC | L313→C314 | | | |
| | AAG→CCT | K184→P185 | TCT→ACG | S314→T315 | | | |
| | TTT→ACG | F209→T210 | TTG→ATG | L315→M316 | | | |
| | ATG→AGA | M212→R213 | ACC→AGT | T317→S318 | | | |
| | AAT→GAT | N214→D215 | *GAC→GAT* | *D329→D330* | | | |
| | CAT→GAT | H219→D220 | AAG→CGA | K336→R337 | | | |
| | TAC→GTT | Y221→V222 | TTA→ATT | L337→I338 | | | |
| | GAG→GAT | E238→D239 | GGT→CGG | G357→R358 | | | |
| | AAA→CAA | K252→Q253 | GAG→GAT | E484→D485 | | | |
| | CCT→TCA | P281→S282 | | | | | |
| | CAA→AAA | Q292→K293 | | | | | |
| | CTC→TGC | L313→C314 | | | | | |
| | AGC→ACG | S314→T315 | | | | | |
| | CTC→ATG | L315→M316 | | | | | |
| | ACT→AGT | T317→S318 | | | | | |
| | CAA→GCT | Q321→A322 | | | | | |
| | GAA→GAT | E333→D334 | | | | | |
| | AAA→CGA | K336→R337 | | | | | |
| | TTG→ATT | L337→I338 | | | | | |
| | GCT→ACA | A345→T346 | | | | | |
| | GGA→CGG | G357→R358 | | | | | |
| | AAT→ATT | N369→I370 | | | | | |
| | TCT→TAC | S377→Y378 | | | | | |
| | ACA→AGA | T405→R406 | | | | | |
| | AAT→GGT | N429→G430 | | | | | |
| | GCA→TCT | A436→S437 | | | | | |
| | GAA→GAT | E484→D485 | | | | | |
| | ACC→CCA | T501→P502 | | | | | |
| | GAT→GAA | D536→E537 | | | | | |

i. V274 and V277

In CVS variants V274 and V277, amino acids 3-41 were replaced by amino acids 3-51 of *Vitis vinafera* (SEQ ID NO:346), amino acids 53-58 were replaced by amino acids 58-63 of TEAS (SEQ ID NO:941), amino acids 85-99 were replaced by amino acids 93-110 of HPS (SEQ ID NO:942) and amino acids 174-184 were replaced by amino acids 185-193 of HPS (SEQ ID NO:942) or 177-185 of TEAS (SEQ ID NO:941). CVS variant V274 was generated by direct yeast recombination using V240 as a template, with primers set forth in Table 25 above. CVS variant V277 was generated by direct yeast recombination using V245 as a template, with primers set forth in Table 25 above. The variants, including amino acid and nucleotide changes versus both wildtype CVS and CVS V19, and valencene production % versus CVS V19 are set forth in Table 35 below.

TABLE 35

CVS Variants

| Mutant | Nucleotide changes vs. wildtype | Amino acid changes vs. wildtype | Nucleotide changes vs. CVS V19 | Amino acid changes vs. CVS V19 | SEQ ID NO nt | SEQ ID NO aa | Valencene production % vs. V19 (Shake Flask) |
|---|---|---|---|---|---|---|---|
| V274 | *TCG→TCT* | *S2S* | *TCA→TCT* | *S2S* | 807 | 864 | 60.13 |
| | TCT→ACT | S3T | TCT→ACT | S3T | | | |
| | GGA→CAA | G4Q | GGT→CAA | G4Q | | | |
| | GAA→GTC | E5V | GAA→GTC | E5V | | | |
| | ---→TCA | ---→S6 | ---→TCA | ---→S6 | | | |
| | ---→GCA | ---→A7 | ---→GCA | ---→A7 | | | |
| | ---→TCT | ---→S8 | ---→TCT | ---→S8 | | | |
| | ---→TCT | ---→S9 | ---→TCT | ---→S9 | | | |
| | ---→CTA | ---→L10 | ---→CTA | ---→L10 | | | |
| | ---→GCC | ---→A11 | ---→GCC | ---→A11 | | | |
| | ---→CAG | ---→Q12 | ---→CAG | ---→Q12 | | | |
| | ---→ATT | ---→I13 | ---→ATT | ---→I13 | | | |
| | ---→CCC | ---→P14 | ---→CCC | ---→P14 | | | |
| | ---→CAA | ---→Q15 | ---→CAA | ---→Q15 | | | |
| | ---→CCC | ---→P16 | ---→CCC | ---→P16 | | | |
| | ACA→AAA | T6→K17 | ACT→AAA | T6→K17 | | | |
| | TTT→AAT | F7→N18 | TTT→AAT | F7→N18 | | | |
| | ACT→GTG | T10→V21 | *AGA→CGT* | *R8→R19* | | | |
| | GAT→AAC | D12→N23 | *CCA→CCT* | *P9→P20* | | | |
| | *CAT→CAC* | *H14→H25* | ACT→GTG | T10→V21 | | | |
| | *CCT→CCC* | *P15→P26* | *GCT→GCA* | *A11→A22* | | | |
| | AGT→AAC | S16→N27 | GAT→AAC | D12→N23 | | | |
| | TTA→ATT | L17→I28 | *CAT→CAC* | *H14→H25* | | | |
| | AGA→GGT | R19→G30 | *CCA→CCC* | *P15→P26* | | | |
| | AAC→GAC | N20→D31 | TCT→AAC | S16→N27 | | | |
| | CAT→CAA | H21→Q32 | TTG→ATT | L17→I28 | | | |
| | CTC→ATC | L23→I34 | AGA→GGT | R19→G30 | | | |
| | AAA→ACC | K24→T35 | AAT→GAC | N20→D31 | | | |
| | GGT→TAC | G25→Y36 | CAT→CAA | H21→Q32 | | | |
| | GCT→ACT | A26→T37 | TTG→ATC | L23→I34 | | | |
| | TCT→CCT | S27→P38 | CAA→ACC | Q24→T35 | | | |
| | GAT→GAA | D28→E39 | GGT→TAC | G25→Y36 | | | |
| | TTC→GAC | F29→D40 | GCA→ACT | A26→T37 | | | |
| | ACA→--- | T31→--- | TCA→CCT | S27→P38 | | | |
| | GAT→ACT | D33→T43 | GAT→GAA | D28→E39 | | | |
| | CAT→CGT | H34→R44 | TTT→GAC | F29→D40 | | | |
| | ACT→GCC | T35→A45 | ACT→--- | T31→--- | | | |
| | GCA→TGC | A36→C46 | GAT→ACT | D33→T43 | | | |
| | ACT→AAA | T37→K47 | CAT→CGT | H34→R44 | | | |
| | CAA→GAG | Q38→E48 | ACA→GCC | T35→A45 | | | |
| | *GAA→GAG* | *E39→E49* | GCT→TGC | A36→C46 | | | |
| | CGA→CAG | R40→Q50 | ACA→AAA | T37→K47 | | | |
| | CAC→ATT | H41→I51 | AAT→GAG | N38→E48 | | | |
| | ACA→TTA | T53→L63 | *GAA→GAG* | *E39→E49* | | | |
| | GAT→GCA | D54→A64 | AGA→CAG | R40→Q50 | | | |
| | GCT→ACC | A55→T65 | CAT→ATT | H41→I51 | | | |
| | GAA→GGA | E56→G66 | ACT→TTA | T53→L63 | | | |
| | GAT→AGG | D57→R67 | GAT→GCA | D54→A64 | | | |
| | *AAG→AAA* | *K58→K68* | GCA→ACC | A55→T65 | | | |
| | GTT→ATT | V60→I70 | GAA→GGA | E56→G66 | | | |
| | GCA→ATG | A85→M95 | GAT→AGG | D57→R67 | | | |
| | ATA→TTG | I86→L96 | CAA→AAA | Q58→K68 | | | |
| | CAA→GAT | Q87→D97 | GCT→ATG | A85→M95 | | | |
| | AAA→CAC | K88→H98 | ATT→TTG | I86→L96 | | | |
| | TTA→ATT | L89→I99 | CAA→GAT | Q87→D97 | | | |
| | TGT→TAC | C90→Y100 | CAA→CAC | Q88→H98 | | | |
| | ---→AGA | ---→R101 | TTG→ATT | L89→I99 | | | |
| | ---→GCT | ---→A102 | TGT→TAC | C90→Y100 | | | |
| | ---→GAT | ---→D103 | ---→AGA | ---→R101 | | | |
| | *CCA→CCT* | *P91→P104* | ---→GCT | ---→A102 | | | |
| | ATC→TAT | I92→Y105 | ---→GAT | ---→D103 | | | |
| | TAT→TTT | Y93→F106 | *CCA→CCT* | *P91→P104* | | | |
| | ATT→GAG | I94→E107 | ATT→TAT | I92→Y105 | | | |
| | GAC→GCT | D95→A108 | CAT→TTT | H93→F106 | | | |
| | AGT→CAT | S96→H109 | ATT→GAG | I94→E107 | | | |
| | AAT→GAA | N97→E110 | GAT→GCT | D95→A108 | | | |
| | AGA→TAC | R98→Y111 | TCT→CAT | S96→H109 | | | |
| | GCT→AAT | A99→N112 | GAT→GAA | D97→E110 | | | |

TABLE 35-continued

CVS Variants

| Mutant | Nucleotide changes vs. wildtype | Amino acid changes vs. wildtype | Nucleotide changes vs. CVS V19 | Amino acid changes vs. CVS V19 | SEQ ID NO nt | SEQ ID NO aa | Valencene production % vs. V19 (Shake Flask) |
|---|---|---|---|---|---|---|---|
| | AAG→CAA | K125→Q138 | AAA→TAC | K98→Y111 | | | |
| | AAG→CAA | K173→Q186 | GCT→AAT | A99→N112 | | | |
| | *TCA→TCT* | *S174→S187* | *TCA→TCT* | *S174→S187* | | | |
| | TTG→--- | L175→--- | TTG→--- | L175→--- | | | |
| | GTA→--- | V176→--- | GTT→--- | V176→--- | | | |
| | CAG→GCT | Q178→A189 | CAA→GCT | Q178→A189 | | | |
| | GAT→CCA | D179→P190 | GAT→CCA | D179→P190 | | | |
| | GTA→TTG | V181→L192 | GTT→TTG | V181→L192 | | | |
| | ACC→AAG | T182→K193 | ACT→AAG | T182→K193 | | | |
| | CCT→TCA | P183→S194 | CCA→TCA | P183→S194 | | | |
| | AAG→CCT | K184→P195 | AGA→CCT | R184→P195 | | | |
| | TTT→ATT | F209→I220 | *GGT→GGG* | *G276→G287* | | | |
| | ATG→AGA | M212→R223 | CCA→TCA | P281→S292 | | | |
| | AAT→GAT | N214→D225 | TTG→TGC | L313→C324 | | | |
| | CAT→GAT | H219→D230 | TCT→ACG | S314→T325 | | | |
| | TAC→GTT | Y221→V232 | TTG→ATG | L315→M326 | | | |
| | GAG→GAT | E238→D249 | ACC→AGT | T317→S328 | | | |
| | AAA→CAA | K252→Q263 | *GAC→GAT* | *D329→D340* | | | |
| | CCT→TCA | P281→S292 | AAG→CGA | K336→R347 | | | |
| | CAA→AAA | Q292→K303 | TTA→ATT | L337→I348 | | | |
| | CTC→TGC | L313→C324 | GGT→CGG | G357→R368 | | | |
| | AGC→ACG | S314→T325 | GAG→GAT | E484→D495 | | | |
| | CTC→ATG | L315→M326 | | | | | |
| | ACT→AGT | T317→S328 | | | | | |
| | CAA→GCT | Q321→A332 | | | | | |
| | GAA→GAT | E333→D344 | | | | | |
| | AAA→CGA | K336→R347 | | | | | |
| | TTG→ATT | L337→I348 | | | | | |
| | GCT→ACA | A345→T356 | | | | | |
| | GGA→CGG | G357→R368 | | | | | |
| | AAT→ATT | N369→I380 | | | | | |
| | TCT→TAC | S377→Y388 | | | | | |
| | ACA→AGA | T405→R416 | | | | | |
| | AAT→GGT | N429→G440 | | | | | |
| | GCA→TCT | A436→S447 | | | | | |
| | GAA→GAT | E484→D495 | | | | | |
| | ACC→CCA | T501→P512 | | | | | |
| | GAT→GAA | D536→E547 | | | | | |
| V277 | *TCG->TCT* | *S2S* | *TCA→TCT* | *S2S* | 891 | 887 | 93.4 |
| | TCT→ACT | S3T | TCT→ACT | S3T | | | |
| | GGA→CAA | G4Q | GGT→CAA | G4Q | | | |
| | GAA→GTC | E5V | GAA→GTC | E5V | | | |
| | ---→TCA | ---→S6 | ---→TCA | ---→S6 | | | |
| | ---→GCA | ---→A7 | ---→GCA | ---→A7 | | | |
| | ---→TCT | ---→S8 | ---→TCT | ---→S8 | | | |
| | ---→TCT | ---→S9 | ---→TCT | ---→S9 | | | |
| | ---→CTA | ---→L10 | ---→CTA | ---→L10 | | | |
| | ---→GCC | ---→A11 | ---→GCC | ---→A11 | | | |
| | ---→CAG | ---→Q12 | ---→CAG | ---→Q12 | | | |
| | ---→ATT | ---→I13 | ---→ATT | ---→I13 | | | |
| | ---→CCC | ---→P14 | ---→CCC | ---→P14 | | | |
| | ---→CAA | ---→Q15 | ---→CAA | ---→Q15 | | | |
| | ---→CCC | ---→P16 | ---→CCC | ---→P16 | | | |
| | ACA→AAA | T6→K17 | ACT→AAA | T6→K17 | | | |
| | TTT→AAT | F7→N18 | TTT→AAT | F7→N18 | | | |
| | ACT→GTG | T10→V21 | *AGA→CGT* | *R8→R19* | | | |
| | GAT→AAC | D12→N23 | *CCA→CCT* | *P9→P20* | | | |
| | *CAT->CAC* | *H14->H25* | ACT→GTG | T10→V21 | | | |
| | *CCT->CCC* | *P15->P26* | *GCT→GCA* | *A11→A22* | | | |
| | AGT→AAC | S16→N27 | GAT→AAC | D12→N23 | | | |
| | TTA→ATT | L17→I28 | *CAT→CAC* | *H14→H25* | | | |
| | AGA→GGT | R19→G30 | *CCA→CCC* | *P15→P26* | | | |
| | AAC→GAC | N20→D31 | TCT→AAC | S16→N27 | | | |
| | CAT→CAA | H21→Q32 | TTG→ATT | L17→I28 | | | |
| | CTC→ATC | L23→I34 | AGA→GGT | R19→G30 | | | |
| | AAA→ACC | K24→T35 | AAT→GAC | N20→D31 | | | |
| | GGT→TAC | G25→Y36 | CAT→CAA | H21→Q32 | | | |
| | GCT→ACT | A26→T37 | TTG→ATC | L23→I34 | | | |
| | TCT→CCT | S27→P38 | CAA→ACC | Q24→T35 | | | |
| | GAT→GAA | D28→E39 | GGT→TAC | G25→Y36 | | | |

TABLE 35-continued

CVS Variants

| Mutant | Nucleotide changes vs. wildtype | Amino acid changes vs. wildtype | Nucleotide changes vs. CVS V19 | Amino acid changes vs. CVS V19 | SEQ ID NO nt | SEQ ID NO aa | Valencene production % vs. V19 (Shake Flask) |
|---|---|---|---|---|---|---|---|
| | TTC→GAC | F29→D40 | GCA→ACT | A26→T37 | | | |
| | ACA→--- | T31→--- | TCA→CCT | S27→P38 | | | |
| | GAT→ACT | D33→T43 | GAT→GAA | D28→E39 | | | |
| | CAT→CGT | H34→R44 | TTT→GAC | F29→D40 | | | |
| | ACT→GCC | T35→A45 | ACT→--- | T31→--- | | | |
| | GCA→TGC | A36→C46 | GAT→ACT | D33→T43 | | | |
| | ACT→AAA | T37→K47 | CAT→CGT | H34→R44 | | | |
| | CAA→GAG | Q38→E48 | ACA→GCC | T35→A45 | | | |
| | *GAA->GAG* | *E39->E49* | GCT→TGC | A36→C46 | | | |
| | CGA→CAG | R40→Q50 | ACA→AAA | T37→K47 | | | |
| | CAC→ATT | H41→I51 | AAT→GAG | N38→E48 | | | |
| | ACA→TTA | T53→L63 | *GAA→GAG* | *E39→E49* | | | |
| | GAT→GCA | D54→A64 | AGA→CAG | R40→Q50 | | | |
| | GCT→ACC | A55→T65 | CAT→ATT | H41→I51 | | | |
| | GAA→GGA | E56→G66 | ACT→TTA | T53→L63 | | | |
| | GAT→AGG | D57→R67 | GAT→GCA | D54→A64 | | | |
| | *AAG→AAA* | *K58→K68* | GCA→ACC | A55→T65 | | | |
| | GTT→ATT | V60→I70 | GAA→GGA | E56→G66 | | | |
| | GCA→ATG | A85→M95 | GAT→AGG | D57→R67 | | | |
| | ATA→TTG | I86→L96 | CAA→AAA | Q58→K68 | | | |
| | CAA→GAT | Q87→D97 | GCT→ATG | A85→M95 | | | |
| | AAA→CAC | K88→H98 | ATT→TTG | I86→L96 | | | |
| | TTA→ATT | L89→I99 | CAA→GAT | Q87→D97 | | | |
| | TGT→TAC | C90→Y100 | CAA→CAC | Q88→H98 | | | |
| | ---→AGA | ---→R101 | TTG→ATT | L89→I99 | | | |
| | ---→GCT | ---→A102 | TGT→TAC | C90→Y100 | | | |
| | ---→GAT | ---→D103 | ---→AGA | ---→R101 | | | |
| | *CCA->CCT* | *P91->P104* | ---→GCT | ---→A102 | | | |
| | ATC→TAT | I92→Y105 | ---→GAT | ---→D103 | | | |
| | TAT→TTT | Y93→F106 | *CCA→CCT* | *P91→P104* | | | |
| | ATT→GAG | I94→E107 | ATT→TAT | I92→Y105 | | | |
| | GAC→GCT | D95→A108 | CAT→TTT | H93→F106 | | | |
| | AGT→CAT | S96→H109 | ATT→GAG | I94→E107 | | | |
| | AAT→GAA | N97→E110 | GAT→GCT | D95→A108 | | | |
| | AGA→TAC | R98→Y111 | TCT→CAT | S96→H109 | | | |
| | GCT→AAT | A99→N112 | GAT→GAA | D97→E110 | | | |
| | AAG→CAA | K125→Q138 | AAA→TAC | K98→Y111 | | | |
| | AAG→CAA | K173→Q186 | GCT→AAT | A99→N112 | | | |
| | *TCA->TCT* | *S174->S187* | *TCA→TCT* | *S174→S187* | | | |
| | TTG→--- | L175→--- | TTG→--- | L175→--- | | | |
| | GTA→--- | V176→--- | GTT→--- | V176→--- | | | |
| | CAG→GCT | Q178→A189 | CAA→GCT | Q178→A189 | | | |
| | GAT→CCA | D179→P190 | GAT→CCA | D179→P190 | | | |
| | GTA→TTG | V181→L192 | GTT→TTG | V181→L192 | | | |
| | ACC→AAG | T182→K193 | ACT→AAG | T182→K193 | | | |
| | CCT→TCA | P183→S194 | CCA→TCA | P183→S194 | | | |
| | AAG→CCT | K184→P195 | AGA→CCT | R184→P195 | | | |
| | TTT→ATT | F209→I220 | AGA→GTC | R212→V223 | | | |
| | ATG→GTC | M212→V223 | ATT→TAC | I213→Y224 | | | |
| | ATC→TAC | I213→Y224 | GAT→--- | D214→--- | | | |
| | AAT→--- | N214→--- | TCT→--- | S215→--- | | | |
| | TCA→--- | S215→--- | ACT→CAA | T216→Q225 | | | |
| | ACA→CAA | T216→Q225 | TCT→GAT | S217→D226 | | | |
| | AGT→GAT | S217→D226 | GAT→GAA | D218→E227 | | | |
| | GAT→GAA | D218→E227 | GAT→GCT | D219→A228 | | | |
| | CAT→GCT | H219→A228 | TTG→TTC | L220→F229 | | | |
| | TTA→TTC | L220→F229 | GTT→CAT | V221→H230 | | | |
| | TAC→CAT | Y221→H230 | TTG→CTG | *L270→L279* | | | |
| | GAG→GAT | E238→D247 | *GGT→GGG* | *G276→G285* | | | |
| | AAA→CAA | K252→Q261 | CCA→TCA | P281→S290 | | | |
| | *TTA→CTG* | *L270→L279* | TTG→TGC | L313→C322 | | | |
| | CCT→TCA | P281→S290 | TCT→ACG | S314→T323 | | | |
| | CAA→AAA | Q292→K301 | TTG→ATG | L315→M324 | | | |
| | CTC→TGC | L313→C322 | ACC→AGT | T317→S326 | | | |
| | AGC→ACG | S314→T323 | *GAC→GAT* | *D329→D338* | | | |
| | CTC→ATG | L315→M324 | AAG→CGA | K336→R345 | | | |
| | ACT→AGT | T317→S326 | TTA→ATT | L337→I346 | | | |
| | CAA→GCT | Q321→A330 | GGT→CGG | G357→R366 | | | |
| | GAA→GAT | E333→D342 | GAG→GAT | E484→D493 | | | |
| | AAA→CGA | K336→R345 | *ATA→ATC* | *I538→I547* | | | |
| | TTG→ATT | L337→I346 | | | | | |

TABLE 35-continued

| CVS Variants | | | | | | | |
|---|---|---|---|---|---|---|---|
| Mutant | Nucleotide changes vs. wildtype | Amino acid changes vs. wildtype | Nucleotide changes vs. CVS V19 | Amino acid changes vs. CVS V19 | SEQ ID NO nt | SEQ ID NO aa | Valencene production % vs. V19 (Shake Flask) |
| | GCT→ACA | A345→T354 | | | | | |
| | GGA→CGG | G357→R366 | | | | | |
| | AAT→ATT | N369→I378 | | | | | |
| | TCT→TAC | S377→Y386 | | | | | |
| | ACA→AGA | T405→R414 | | | | | |
| | AAT→GGT | N429→G438 | | | | | |
| | GCA→TCT | A436→S445 | | | | | |
| | GAA→GAT | E484→D493 | | | | | |
| | ACC→CCA | T501→P510 | | | | | |
| | GAT→GAA | D536→E545 | | | | | |
| | *ATT->ATC* | *I538->I547* | | | | | |

j. V275 and V276

In CVS variants V275 and V276, amino acids 85-99 were replaced by amino acids 96-113 of *Vitis vinifera* (SEQ ID NO:346) as described above (see Table 25). CVS Variants V275 and V276 were generated by direct yeast recombination using V75 as a template. Mutagenic oligo 21-141.7 was used in a single PCR reaction with oligo 11-154.4 and mutagenic oligo 21-141.8 was used in a single PCR reaction with oligo 11-154.3, with oligos set forth in Table 25 above. The variants, including amino acid and nucleotide changes versus both wildtype CVS and CVS V19, and valencene production % versus CVS V19 are set forth in Table 36 below. V275 and V276 differ by one mutation, Y387→C389 in V276.

TABLE 36

| CVS Variants | | | | | | | |
|---|---|---|---|---|---|---|---|
| Mutant | Nucleotide changes vs. wildtype | Amino acid changes vs. wildtype | Nucleotide changes vs. CVS V19 | Amino acid changes vs. CVS V19 | SEQ ID NO nt | SEQ ID NO aa | Valencene production % vs. V19 (Shake Flask) |
| V275 | AAA→CAA | K24Q | *GCT→GCA* | *A85A* | 808 | 865 | 82.8 |
| | CAA→AAT | Q38N | ATT→TTA | I86L | | | |
| | AAG→CAA | K58Q | CAA→CAT | Q88H | | | |
| | GTT→ATT | V60I | TTG→ATT | L89I | | | |
| | ATA→TTA | I86L | CCA→AAT | P91N | | | |
| | AAA→CAT | K88H | ATT→AAT | I92N | | | |
| | TTA→ATT | L89I | CAT→TTT | H93F | | | |
| | CCA→AAT | P91N | ATT→CAT | I94H | | | |
| | ATC→AAT | I92N | *GAT→GAC* | *D95D* | | | |
| | TAT→TTT | Y93F | TCT→TGC | S96C | | | |
| | ATT→CAT | I94H | GAT→AAT | D97N | | | |
| | AGT→TGC | S96C | AAA→GAT | K98D | | | |
| | AGA→GAT | R98D | GCT→ATG | A99M | | | |
| | GCT→ATG | A99M | ---→GGT | ---→G101 | | | |
| | --- →GGT | --- →G101 | ---→GAT | ---→D102 | | | |
| | --- →GAT | --- →D102 | *GGT→GGG* | *G276→G278* | | | |
| | AAG→CAA | K125→Q127 | CCA→TCA | P281→S283 | | | |
| | AAG→CAA | K173→Q175 | TTG→TGC | L313→C315 | | | |
| | AAG→AGA | K184→R186 | TCT→ACG | S314→T316 | | | |
| | TTT→ATT | F209→I211 | TTG→ATG | L315→M317 | | | |
| | ATG→AGA | M212→R214 | ACC→AGT | T317→S319 | | | |
| | AAT→GAT | N214→D216 | *GAC→GAT* | *D329→D331* | | | |
| | CAT→GAT | H219→D221 | AAG→CGA | K336→R338 | | | |
| | TAC→GTT | Y221→V223 | TTA→ATT | L337→I339 | | | |
| | GAG→GAT | E238→D240 | GGT→CGG | G357→R359 | | | |
| | AAA→CAA | K252→Q254 | | | | | |
| | CCT→TCA | P281→S283 | | | | | |
| | CAA→AAA | Q292→K294 | | | | | |
| | CTC→TGC | L313→C315 | | | | | |
| | AGC→ACG | S314→T316 | | | | | |
| | CTC→ATG | L315→M317 | | | | | |
| | ACT→AGT | T317→S319 | | | | | |
| | CAA→GCT | Q321→A323 | | | | | |
| | GAA→GAT | E333→D335 | | | | | |
| | AAA→CGA | K336→R338 | | | | | |
| | TTG→ATT | L337→I339 | | | | | |

TABLE 36-continued

| CVS Variants | | | | | | | |
|---|---|---|---|---|---|---|---|
| Mutant | Nucleotide changes vs. wildtype | Amino acid changes vs. wildtype | Nucleotide changes vs. CVS V19 | Amino acid changes vs. CVS V19 | SEQ ID NO nt | SEQ ID NO aa | Valencene production % vs. V19 (Shake Flask) |
| | GCT→ACA | A345→T347 | | | | | |
| | GGA→CGG | G357→R359 | | | | | |
| | AAT→ATT | N369→I371 | | | | | |
| | TCT→TAC | S377→Y379 | | | | | |
| | ACA→AGA | T405→R407 | | | | | |
| | AAT→GGT | N429→G431 | | | | | |
| | GCA→TCT | A436→S438 | | | | | |
| | ACC→CCA | T501→P503 | | | | | |
| | GAT→GAA | D536→E538 | | | | | |
| V276 | AAA→CAA | K24Q | *GCT→GCA* | *A85A* | 866 | 809 | 107 |
| | CAA→AAT | Q38N | ATT→TTA | I86L | | | |
| | AAG→CAA | K58Q | CAA→CAT | Q88H | | | |
| | GTT→ATT | V60I | TTG→ATT | L89I | | | |
| | ATA→TTA | I86L | CCA→AAT | P91N | | | |
| | AAA→CAT | K88H | ATT→AGT | I92S | | | |
| | TTA→ATT | L89I | CAT→TTT | H93F | | | |
| | CCA→AAT | P91N | ATT→CAT | I94H | | | |
| | ATC→AGT | I92S | *GAT→GAC* | *D95D* | | | |
| | TAT→TTT | Y93F | TCT→TGC | S96C | | | |
| | ATT→CAT | I94H | GAT→AAT | D97N | | | |
| | AGT→TGC | S96C | AAA→GAT | K98D | | | |
| | AGA→GAT | R98D | GCT→ATG | A99M | | | |
| | GCT→ATG | A99M | ---→GGT | ---→G101 | | | |
| | --- →GGT | --- →G101 | ---→GAT | ---→D102 | | | |
| | --- →GAT | --- →D102 | *TTG→CTG* | *L147→L149* | | | |
| | AAG→CAA | K125→Q127 | *GGT→GGG* | *G276→G278* | | | |
| | *TTG->CTG* | *L147->L149* | CCA→TCA | P281→S283 | | | |
| | AAG→CAA | K173→Q175 | TTG→TGC | L313→C315 | | | |
| | AAG→AGA | K184→R186 | TCT→ACG | S314→T316 | | | |
| | TTT→ATT | F209→I211 | TTG→ATG | L315→M317 | | | |
| | ATG→AGA | M212→R214 | ACC→AGT | T317→S319 | | | |
| | AAT→GAT | N214→D216 | *GAC→GAT* | *D329→D331* | | | |
| | CAT→GAT | H219→D221 | AAG→CGA | K336→R338 | | | |
| | TAC→GTT | Y221→V223 | TTA→ATT | L337→I339 | | | |
| | GAG→GAT | E238→D240 | GGT→CGG | G357→R359 | | | |
| | AAA→CAA | K252→Q254 | TAT→TGT | Y387→C389 | | | |
| | CCT→TCA | P281→S283 | *ATT→ATC* | *I440→I442* | | | |
| | CAA→AAA | Q292→K294 | | | | | |
| | CTC→TGC | L313→C315 | | | | | |
| | AGC→ACG | S314→T316 | | | | | |
| | CTC→ATG | L315→M317 | | | | | |
| | ACT→AGT | T317→S319 | | | | | |
| | CAA→GCT | Q321→A323 | | | | | |
| | GAA→GAT | E333→D335 | | | | | |
| | AAA→CGA | K336→R338 | | | | | |
| | TTG→ATT | L337→I339 | | | | | |
| | GCT→ACA | A345→T347 | | | | | |
| | GGA→CGG | G357→R359 | | | | | |
| | AAT→ATT | N369→I371 | | | | | |
| | TCT→TAC | S377→Y379 | | | | | |
| | TAC→TGT | Y387→C389 | | | | | |
| | ACA→AGA | T405→R407 | | | | | |
| | AAT→GGT | N429→G431 | | | | | |
| | GCA→TCT | A436→S438 | | | | | |
| | ACC→CCA | T501→P503 | | | | | |
| | GAT→GAA | D536→E538 | | | | | |

k. V278, V279, V280 and V281

CVS variants V278, V279, V280 and V281 were generated by error-prone PCR as described in Example 3.a using V240 and V245 as templates, with the following exceptions. First, primers 11-154.3 and 11-154.4 (see Table 25) were used in the PCR reactions. Second, cloning was accomplished by direct yeast recombination as in Example 5.1. The variants, including amino acid and nucleotide changes versus both wildtype CVS and CVS V19, and valencene production % versus CVS V19 are set forth in Table 37 below.

TABLE 37

| CVS Variants | | | | | | | |
|---|---|---|---|---|---|---|---|
| Mutant | Nucleotide changes vs. wildtype | Amino acid changes vs. wildtype | Nucleotide changes vs. CVS V19 | Amino acid changes vs. CVS V19 | SEQ ID NO nt | SEQ ID NO aa | Valencene production % vs. V19 (Shake Flask) |
| V278 | AGA→AAA | R19K | AGA→AAA | R19K | 888 | 892 | 66 |
| | AAA→CAA | K24Q | ACT→TTA | T53L | | | |
| | CAA→AAT | Q38N | GAT→GCA | D54A | | | |
| | ACA→TTA | T53L | GCA→ACC | A55T | | | |
| | GAT→GCA | D54A | GAA→GGA | E56G | | | |
| | GCT→ACC | A55T | GAT→AGG | D57R | | | |
| | GAA→GGA | E56G | CAA→AAA | Q58K | | | |
| | GAT→AGG | D57R | GCT→ATG | A85M | | | |
| | *AAG→AAA* | *K58K* | ATT→TTG | I86L | | | |
| | GTT→ATT | V60I | CAA→GAT | Q87D | | | |
| | GCA→ATG | A85M | CAA→CAC | Q88H | | | |
| | ATA→TTG | I86L | TTG→ATT | L89I | | | |
| | CAA→GAT | Q87D | TGT→TAC | C90Y | | | |
| | AAA→CAC | K88H | ---→AGA | ---→R91 | | | |
| | TTA→ATT | L89I | ---→GCT | ---→A92 | | | |
| | TGT→TAC | C90Y | ---→GAT | ---→D93 | | | |
| | --- →AGA | --- →R91 | *CCA→CCT* | *P91→P94* | | | |
| | --- →GCT | --- →A92 | ATT→TAT | I92→Y95 | | | |
| | --- →GAT | --- →D93 | CAT→TTT | H93→F96 | | | |
| | *CCA->CCT* | *P91->P94* | ATT→GAG | I94→E97 | | | |
| | ATC→TAT | I92→Y95 | GAT→GCT | D95→A98 | | | |
| | TAT→TTT | Y93→F96 | TCT→CAC | S96→H99 | | | |
| | ATT→GAG | I94→E97 | GAT→GAA | D97→E100 | | | |
| | GAC→GCT | D95→A98 | AAA→TAC | K98→Y101 | | | |
| | AGT→CAC | S96→H99 | GCT→AAT | A99→N102 | | | |
| | AAT→GAA | N97→E100 | *GCT→GCA* | *A150→A153* | | | |
| | AGA→TAC | R98→Y101 | *TCA→TCT* | *S174→S177* | | | |
| | GCT→AAT | A99→N102 | TTG→--- | L175→--- | | | |
| | AAG→CAA | K125→Q128 | GTT→--- | V176→--- | | | |
| | AAG→CAA | K173→Q176 | CAA→GCT | Q178→A179 | | | |
| | *TCA→TCT* | *S174→S177* | GAT→CCA | D179→P180 | | | |
| | TTG→--- | L175→--- | GTT→TTG | V181→L182 | | | |
| | GTA→--- | V176→--- | ACT→AAG | T182→K183 | | | |
| | CAG→GCT | Q178→A179 | CCA→TCA | P183→S184 | | | |
| | GAT→CCA | D179→P180 | AGA→CCT | R184→P185 | | | |
| | GTA→TTG | V181→L182 | *AGA→AGG* | *R198→R199* | | | |
| | ACC→AAG | T182→K183 | GAT→GTT | D214→V215 | | | |
| | CCT→TCA | P183→S184 | *GGT→GGG* | *G276→G277* | | | |
| | AAG→CCT | K184→P185 | CCA→TCA | P281→S282 | | | |
| | *CGT->AGG* | *R198->R199* | TTG→TGC | L313→C314 | | | |
| | TTT→ATT | F209→I210 | TCT→ACG | S314→T315 | | | |
| | ATG→AGA | M212→R213 | TTG→ATG | L315→M316 | | | |
| | AAT→GTT | N214→V215 | ACC→AGT | T317→S318 | | | |
| | CAT→GAT | H219→D220 | *GAC→GAT* | *D329→D330* | | | |
| | TAC→GTT | Y221→V222 | AAG→CGA | K336→R337 | | | |
| | GAG→GAT | E238→D239 | TTA→ATT | L337→I338 | | | |
| | AAA→CAA | K252→Q253 | GGT→CGG | G357→R358 | | | |
| | CCT→TCA | P281→S282 | GAG→GAT | E484→D485 | | | |
| | *ACT→ACC* | *T303→T304* | CCA→TCA | P506→S507 | | | |
| | CAA→AAA | Q292→K293 | | | | | |
| | CTC→TGC | L313→C314 | | | | | |
| | AGC→ACG | S314→T315 | | | | | |
| | CTC→ATG | L315→M316 | | | | | |
| | ACT→AGT | T317→S318 | | | | | |
| | CAA→GCT | Q321→A322 | | | | | |
| | GAA→GAT | E333→D334 | | | | | |
| | AAA→CGA | K336→R337 | | | | | |
| | TTG→ATT | L337→I338 | | | | | |
| | GCT→ACA | A345→T346 | | | | | |
| | GGA→CGG | G357→R358 | | | | | |
| | AAT→ATT | N369→I370 | | | | | |
| | TCT→TAC | S377→Y378 | | | | | |
| | ACA→AGA | T405→R406 | | | | | |
| | AAT→GGT | N429→G430 | | | | | |
| | GCA→TCT | A436→S437 | | | | | |
| | GAA→GAT | E484→D485 | | | | | |
| | ACC→CCA | T501→P502 | | | | | |
| | CCA→TCA | P506→S507D | | | | | |
| | GAT→GAA | 536→E537 | | | | | |

TABLE 37-continued

CVS Variants

| Mutant | Nucleotide changes vs. wildtype | Amino acid changes vs. wildtype | Nucleotide changes vs. CVS V19 | Amino acid changes vs. CVS V19 | SEQ ID NO nt | SEQ ID NO aa | Valencene production % vs. V19 (Shake Flask) |
|---|---|---|---|---|---|---|---|
| V279 | AGA→AAA | R19K | AGA→AAA | R19K | 889 | 893 | 75 |
| | AAA→CAA | K24Q | ACT→TTA | T53L | | | |
| | CAA→AAT | Q38N | GAT→GCA | D54A | | | |
| | ACA→TTA | T53L | GCA→ACC | A55T | | | |
| | GAT→GCA | D54A | GAA→GGA | E56G | | | |
| | GCT→ACC | A55T | GAT→AGG | D57R | | | |
| | GAA→GGA | E56G | CAA→AAA | Q58K | | | |
| | GAT→AGG | D57R | GCT→ATG | A85M | | | |
| | *AAG->AAA* | *K58K* | ATT→TTG | I86L | | | |
| | GTT→ATT | V60I | CAA→GAT | Q87D | | | |
| | GCA→ATG | A85M | CAA→CAC | Q88H | | | |
| | ATA→TTG | I86L | TTG→ATT | L89I | | | |
| | CAA→GAT | Q87D | TGT→TAC | C90Y | | | |
| | AAA→CAC | K88H | ---→AGA | ---→R91 | | | |
| | TTA→ATT | L89I | ---→GCT | ---→A92 | | | |
| | TGT→TAC | C90Y | ---→GAT | ---→D93 | | | |
| | ---→AGA | ---→R91 | *CCA→CCT* | *P91→P94* | | | |
| | ---→GCT | ---→A92 | ATT→TAT | I92→Y95 | | | |
| | ---→GAT | ---→D93 | CAT→TTT | H93→F96 | | | |
| | *CCA->CCT* | *P91->P94* | ATT→GAG | I94→E97 | | | |
| | ATC→TAT | I92→Y95 | GAT→GCT | D95→A98 | | | |
| | TAT→TTT | Y93→F96 | TCT→CAT | S96→H99 | | | |
| | ATT→GAG | I94→E97 | GAT→GAA | D97→E100 | | | |
| | GAC→GCT | D95→A98 | AAA→TAC | K98→Y101 | | | |
| | AGT→CAT | S96→H99 | GCT→AAT | A99→N102 | | | |
| | AAT→GAA | N97→E100 | *TCA→TCT* | *S174→S177* | | | |
| | AGA→TAC | R98→Y101 | TTG→--- | L175→--- | | | |
| | GCT→AAT | A99→N102 | GTT→--- | V176→--- | | | |
| | AAG→CAA | K125→Q128 | CAA→GCT | Q178→A179 | | | |
| | AAG→CAA | K173→Q176 | GAT→CCA | D179→P180 | | | |
| | *TCA->TCT* | *S174->S177* | GTT→TTG | V181→L182 | | | |
| | TTG→--- | L175→--- | ACT→AAG | T182→K183 | | | |
| | GTA→--- | V176→--- | CCA→TCA | P183→S184 | | | |
| | CAG→GCT | Q178→A179 | AGA→CCT | R184→P185 | | | |
| | GAT→CCA | D179→P180 | ACT→GCT | T257→A258 | | | |
| | GTA→TTG | V181→L182 | *GGT→GGG* | *G276→G277* | | | |
| | ACC→AAG | T182→K183 | CCA→TCA | P281→S282 | | | |
| | CCT→TCA | P183→S184 | TTG→TGC | L313→C314 | | | |
| | AAG→CCT | K184→P185 | TCT→ACG | S314→T315 | | | |
| | TTT→ATT | F209→I210 | TTG→ATG | L315→M316 | | | |
| | ATG→AGA | M212→R213 | ACC→AGT | T317→S318 | | | |
| | AAT→GAT | N214→D215 | *GAC→GAT* | *D329→D330* | | | |
| | CAT→GAT | H219→D220 | AAG→CGA | K336→R337 | | | |
| | TAC→GTT | Y221→V222 | TTA→ATT | L337→I338 | | | |
| | GAG→GAT | E238→D239 | GGT→CGG | G357→R358 | | | |
| | AAA→CAA | K252→Q253 | AAT→AGT | N410→S411 | | | |
| | ACT→GCT | T257→A258 | GAG→GAT | E484→D485 | | | |
| | CCT→TCA | P281→S282 | | | | | |
| | CAA→AAA | Q292→K293 | | | | | |
| | CTC→TGC | L313→C314 | | | | | |
| | AGC→ACG | S314→T315 | | | | | |
| | CTC→ATG | L315→M316 | | | | | |
| | ACT→AGT | T317→S318 | | | | | |
| | CAA→GCT | Q321→A322 | | | | | |
| | GAA→GAT | E333→D334 | | | | | |
| | AAA→CGA | K336→R337 | | | | | |
| | TTG→ATT | L337→I338 | | | | | |
| | GCT→ACA | A345→T346 | | | | | |
| | GGA→CGG | G357→R358 | | | | | |
| | AAT→ATT | N369→I370 | | | | | |
| | TCT→TAC | S377→Y378 | | | | | |
| | ACA→AGA | T405→R406 | | | | | |
| | AAT→AGT | N410→S411 | | | | | |
| | AAT→GGT | N429→G430 | | | | | |
| | GCA→TCT | A436→S437 | | | | | |
| | GAA→GAT | E484→D485 | | | | | |
| | ACC→CCA | T501→P502 | | | | | |
| | GAT→GAA | D536→E537 | | | | | |

TABLE 37-continued

CVS Variants

| Mutant | Nucleotide changes vs. wildtype | Amino acid changes vs. wildtype | Nucleotide changes vs. CVS V19 | Amino acid changes vs. CVS V19 | SEQ ID NO nt | SEQ ID NO aa | Valencene production % vs. V19 (Shake Flask) |
|---|---|---|---|---|---|---|---|
| V280 | AGA→AAA | R19K | AGA→AAA | R19K | 890 | 894 | 70 |
| | AAA→CAA | K24Q | ACT→TTA | T53L | | | |
| | CAA→AAT | Q38N | GAT→GCA | D54A | | | |
| | ACA→TTA | T53L | GCA→ACC | A55T | | | |
| | GAT→GCA | D54A | GAA→GGA | E56G | | | |
| | GCT→ACC | A55T | GAT→AGG | D57R | | | |
| | GAA→GGA | E56G | CAA→AAA | Q58K | | | |
| | GAT→AGG | D57R | ATT→GTT | I60V | | | |
| | *AAG→AAA* | *K58K* | GTT→CTT | V69L | | | |
| | GTA→CTT | V69L | GCT→ATG | A85M | | | |
| | GCA→ATG | A85M | ATT→TTG | I86L | | | |
| | ATA→TTG | I86L | CAA→GAT | Q87D | | | |
| | CAA→GAT | Q87D | CAA→CAC | Q88H | | | |
| | AAA→CAC | K88H | TTG→ATT | L89I | | | |
| | TTA→ATT | L89I | TGT→TAC | C90Y | | | |
| | TGT→TAC | C90Y | ---→AGA | ---→R91 | | | |
| | --- →AGA | --- →R91 | ---→GCT | ---→A92 | | | |
| | --- →GCT | --- →A92 | ---→GAT | ---→D93 | | | |
| | --- →GAT | --- →D93 | *CCA→CCT* | *P91→P94* | | | |
| | *CCA->CCT* | *P91->P94* | ATT→TAT | I92→Y95 | | | |
| | ATC→TAT | I92→Y95 | CAT→TTT | H93→F96 | | | |
| | TAT→TTT | Y93→F96 | ATT→GAG | I94→E97 | | | |
| | ATT→GAG | I94→E97 | GAT→GCT | D95→A98 | | | |
| | GAC→GCT | D95→A98 | TCT→CAT | S96→H99 | | | |
| | AGT→CAT | S96→H99 | GAT→GAA | D97→E100 | | | |
| | AAT→GAA | N97→E100 | AAA→TAC | K98→Y101 | | | |
| | AGA→TAC | R98→Y101 | GCT→AAT | A99→N102 | | | |
| | GCT→AAT | A99→N102 | *ACT→ACC* | *T103→T106* | | | |
| | AAG→CAA | K125→Q128 | *TCA→TCT* | *S174→S177* | | | |
| | AAG→CAA | K173→Q176 | TTG→--- | L175→--- | | | |
| | *TCA→TCT* | *S174→S177* | GTT→--- | V176→--- | | | |
| | TTG→--- | L175→--- | CAA→GCT | Q178→A179 | | | |
| | GTA→--- | V176→--- | GAT→CCA | D179→P180 | | | |
| | CAG→GCT | Q178→A179 | GTT→TTG | V181→L182 | | | |
| | GAT→CCA | D179→P180 | ACT→AAG | T182→K183 | | | |
| | GTA→TTG | V181→L182 | CCA→TCA | P183→S184 | | | |
| | ACC→AAG | T182→K183 | AGA→CCT | R184→P185 | | | |
| | CCT→TCA | P183→S184 | *GGT→GGG* | *G276→G277* | | | |
| | AAG→CCT | K184→P185 | CCA→TCA | P281→S282 | | | |
| | TTT→ATT | F209→I210 | TTG→TGC | L313→C314 | | | |
| | ATG→AGA | M212→R213 | TCT→ACG | S314→T315 | | | |
| | AAT→GAT | N214→D215 | TTG→ATG | L315→M316 | | | |
| | CAT→GAT | H219→D220 | ACC→AGT | T317→S318 | | | |
| | TAC→GTT | Y221→V222 | *GAC→GAT* | *D329→D330* | | | |
| | GAG→GAT | E238→D239 | AAG→CGA | K336→R337 | | | |
| | AAA→CAA | K252→Q253 | TTA→ATT | L337→I338 | | | |
| | CCT→TCA | P281→S282 | GGT→CGG | G357→R358 | | | |
| | CAA→AAA | Q292→K293 | GAG→GAT | E484→D485 | | | |
| | CTC→TGC | L313→C314 | | | | | |
| | AGC→ACG | S314→T315 | | | | | |
| | CTC→ATG | L315→M316 | | | | | |
| | ACT→AGT | T317→S318 | | | | | |
| | CAA→GCT | Q321→A322 | | | | | |
| | GAA→GAT | E333→D334 | | | | | |
| | AAA→CGA | K336→R337 | | | | | |
| | TTG→ATT | L337→I338 | | | | | |
| | GCT->ACA | A345→T346 | | | | | |
| | GGA→CGG | G357→R358 | | | | | |
| | AAT→ATT | N369→I370 | | | | | |
| | TCT→TAC | S377→Y378 | | | | | |
| | ACA→AGA | T405→R406 | | | | | |
| | AAT→GGT | N429→G430 | | | | | |
| | GCA→TCT | A436→S437 | | | | | |
| | GAA→GAT | E484→D485 | | | | | |
| | ACC→CCA | T501→P502 | | | | | |
| | GAT→GAA | D536→E537 | | | | | |
| V281 | AGA→AAA | R19K | *TTT→TTC* | *F13F* | 896 | 895 | 90.17 |
| | AAA→CCA | K24P | AGA→AAA | R19K | | | |
| | CAA→TAT | Q38Y | CAA→CCA | Q24P | | | |

TABLE 37-continued

| CVS Variants | | | | | | | |
|---|---|---|---|---|---|---|---|
| | | | | | | | Valencene production |
| | Nucleotide changes vs. | Amino acid changes vs. | Nucleotide changes vs. | Amino acid changes vs. | SEQ ID NO | | % vs. V19 (Shake |
| Mutant | wildtype | wildtype | CVS V19 | CVS V19 | nt | aa | Flask) |
| | ACA→TTA | T53L | AAT→TAT | N38Y | | | |
| | GAT→GCA | D54A | ACT→TTA | T53L | | | |
| | GCT→ACC | A55T | GAT→GCA | D54A | | | |
| | GAA→GGA | E56G | GCA→ACC | A55T | | | |
| | GAT→AGG | D57R | GAA→GGA | E56G | | | |
| | *AAG->AAA* | *K58K* | GAT→AGG | D57R | | | |
| | GTT→ATT | V60I | CAA→AAA | Q58K | | | |
| | GCA→ATG | A85M | GCT→ATG | A85M | | | |
| | ATA→TTG | I86L | ATT→TTG | I86L | | | |
| | CAA→GAT | Q87D | CAA→GAT | Q87D | | | |
| | AAA→CAC | K88H | CAA→CAC | Q88H | | | |
| | TTA→ATT | L89I | TTG→ATT | L89I | | | |
| | TGT→TAC | C90Y | TGT→TAC | C90Y | | | |
| | ---→AGA | ---→R91 | ---→AGA | ---→R91 | | | |
| | ---→GCT | ---→A92 | ---→GCT | ---→A92 | | | |
| | ---→GAT | ---→D93 | ---→GAT | ---→D93 | | | |
| | *CCA->CCT* | *P91->P94* | *CCA→CCT* | *P91→P94* | | | |
| | ATC→TAT | I92→Y95 | ATT→TAT | I92→Y95 | | | |
| | TAT→TTT | Y93→F96 | CAT→TTT | H93→F96 | | | |
| | ATT→GAG | I94→E97 | ATT→GAG | I94→E97 | | | |
| | GAC→GCT | D95→A98 | GAT→GCT | D95→A98 | | | |
| | AGT→CAT | S96→H99 | TCT→CAT | S96→H99 | | | |
| | AAT→GAA | N97→E100 | GAT→GAA | D97→E100 | | | |
| | AGA→TAC | R98→Y101 | AAA→TAC | K98→Y101 | | | |
| | GCT→AAT | A99→N102 | GCT→AAT | A99→N102 | | | |
| | AAG→CAA | K125→Q128 | *TCA→TCT* | *S174→S177* | | | |
| | AAG→CAA | K173→Q176 | TTG→--- | L175→--- | | | |
| | *TCA->TCT* | *S174->S177* | GTT→--- | V176→--- | | | |
| | TTG→--- | L175→--- | CAA→GCT | Q178→A179 | | | |
| | GTA→--- | V176→--- | GAT→CCA | D179→P180 | | | |
| | CAG→GCT | Q178→A179 | GTT→TTG | V181→L182 | | | |
| | GAT→CCA | D179→P180 | ACT→AAG | T182→K183 | | | |
| | GTA→TTG | V181→L182 | CCA→TCA | P183→S184 | | | |
| | ACC→AAG | T182→K183 | AGA→CCT | R184→P185 | | | |
| | CCT→TCA | P183→S184 | AGA→GTC | R212→V213 | | | |
| | AAG→CCT | K184→P185 | ATT→TAC | I213→Y214 | | | |
| | TTT→ATT | F209→I210 | GAT→--- | D214→--- | | | |
| | ATG→GTC | M212→V213 | TCT→--- | S215→--- | | | |
| | ATC→TAC | I213→Y214 | ACT→CAA | T216→Q215 | | | |
| | AAT→--- | N214→--- | TCT→GAT | S217→D216 | | | |
| | TCA→--- | S215→--- | GAT→GAA | D218→E217 | | | |
| | ACA→CAA | T216→Q215 | GAT→GCT | D219→A218 | | | |
| | AGT→GAT | S217→D216 | TTG→TTC | L220→F219 | | | |
| | GAT→GAA | D218→E217 | GTT→CAT | V221→H220 | | | |
| | CAT→GCT | H219→A218 | GGT→GGG | G276→G275 | | | |
| | TTA→TTC | L220→F219 | CCA→TCA | P281→S280 | | | |
| | TAC→CAT | Y221→H220 | TTG→TGC | L313→C312 | | | |
| | GAG→GAT | E238→D237 | TCT→ACG | S314→T313 | | | |
| | AAA→CAA | K252→Q251 | TTG→ATG | L315→M314 | | | |
| | CCT→TCA | P281→S280 | ACC→AGT | T317→S316 | | | |
| | CAA→AAA | Q292→K291 | *GAC→GAT* | *D329→D328* | | | |
| | CTC→TGC | L313→C312 | AAG→CGA | K336→R335 | | | |
| | AGC→ACG | S314→T313 | TTA→ATT | L337→I336 | | | |
| | CTC→ATG | L315→M314 | GGT→CGG | G357→R356 | | | |
| | ACT→AGT | T317→S316 | GAG→GAT | E484→D483 | | | |
| | CAA→GCT | Q321→A320 | | | | | |
| | GAA→GAT | E333→332 | | | | | |
| | AAA→CGA | K336→R335 | | | | | |
| | TTG→ATT | L337→I336 | | | | | |
| | GCT→ACA | A345→T344 | | | | | |
| | GGA→CGG | G357→R356 | | | | | |
| | AAT→ATT | N369→I368 | | | | | |
| | TCT→TAC | S377→Y376 | | | | | |
| | ACA→AGA | T405→R404 | | | | | |
| | AAT→GGT | N429→G428 | | | | | |
| | GCA→TCT | A436→S435 | | | | | |
| | GAA→GAT | E484→D483 | | | | | |
| | ACC→CCA | T501→P500 | | | | | |
| | GAT→GAA | D536→E535 | | | | | |

Example 6

Generation and Screening of Further Valencene Synthase Mutants

Further additional valencene synthase mutants were produced using a variety of methods. The mutants were generated as described below in subsections a-f.

Mutants were screened in ALX7-95 using the microvial method described in Example 3.C.2, above, and mutants with >110% valencene productivity of CVS V19 (i.e., 10% increase in valencene versus CVS V19) were further screened in shake flask cultures. Tables 38-40 below sets forth the amino acid changes based on the designed sequence, although attempts to sequence the mutants were not successful. The Tables also set forth the percent (%) valencene production in initial microcultures and shake flask cultures relative to the valencene production of transformants containing the CVS V19 gene.

a. V282

CVS V19 (SEQ ID NO:129) was used as a template to generate V282. In CVS variant V282, amino acids 53-58 were replaced by amino acids 58-63 of TEAS (SEQ ID NO:941), amino acids 85-99 were replaced by amino acids 93-110 of HPS (SEQ ID NO:942) and amino acids 174-184 were replaced by amino acids 185-193 of HPS (SEQ ID NO:942) or 177-185 of TEAS (SEQ ID NO:941), and amino acids 212-221 were replaced by random amino acids as described above (see Table 27). This mutant was prepared as described above in Example 5f.

TABLE 38

CVS Variant V282

| Mutant | Amino Acid Changes | Initial micro-culture % vs. V19 | Valencene production % vs. V19 (Shake Flask) |
|---|---|---|---|
| V282 | All V240 mutations plus up to 10 additional amino acid changes from AA212-221 | ND | 96.30 |

b. V283

CVS variant V283 was generated as described in Example 5f above for CVS variant V246, using V241 as a template. Several additional isolates were identified that produce >77% valencene as compared to CVS V19, but additionally produce high amounts of b-elemene.

TABLE 39

CVS Variant V283

| Mutant | Amino Acid Changes | Initial micro-culture % vs. V19 | Valencene production % vs. V19 (Shake Flask) |
|---|---|---|---|
| V283 | All V241 mutations plus up to 10 additional amino acid changes from AA212-221 | ND | 94.01 |

c. V284 and V285

CVS variants V284 and V285 were generated as described in Example 5f above for CVS variant V246, using V240 as a template. Several additional isolates were identified that produce greater than approximately 77% of the valencene titer of CVS V19, but additionally produce high amounts of b-elemene.

TABLE 40

CVS Variants V284 and V285

| Mutant | Amino Acid Changes | Initial micro-culture % vs. V19 | Valencene production % vs. V19 (Shake Flask) |
|---|---|---|---|
| V284 | All V240 mutations plus up to 10 additional amino acid changes from AA212-221 | ND | 80.92 |
| V285 | All V240 mutations plus up to 10 additional amino acid changes from AA212-221 | ND | 94.96 |

d. Variants Containing Randomized Residues from Amino Acids 212-221

CVS V19 and V75 were used as templates to generate additional CVS variants containing randomized residues from amino acids 212-221. These mutants were generated as previously described in Example 5f above. Eight isolates generated using CVS V19 as a template were identified as producing >80% valencene as compared to CVS V19. Twelve isolates generated using V75 as a template were identified as producing >74% valencene as compared to CVS V19.

e. Variants Containing Directed Point Mutations

Additional CVS variants were generated containing point mutations at positions L310, H360 or Q370 as set forth below by a single PCR reaction from the template gene using forward and reverse oligos set forth in Table 25 above.

Variants containing the point mutation L310H were generated, whereby V75 and V240 were modified to have the mutation L310H. The variants were tested in microculture for production of valencene. The results showed that V75+L310H averaged 95.5% of valencene production of variant V19, while V240+L310H averaged 77.7% valencene production of variant V19. The results suggested that the L310H mutation did not have a positive impact in the V240 background.

Further, V19 was used as a template to generate point mutations at amino acid H360 or Q370, and 8 individual isolates were identified that produced 68-100% valencene as compared to CVS V19.

f. Variants Containing Swaps at the N-Terminus

Additional CVS variants were generated containing swaps at the extreme N-terminus of CVS by replacement of nucleotides encoding residues 1-15 of CVS with corresponding sequences from each of three heterologous terpene synthase genes. The three heterologous terpene synthase genes were 5-epi-aristolochene synthase from *Nicotiana tabacum* (TEAS, SEQ ID NO:941), premnaspirodiene synthase from *Hyoscyamus muticus* (HPS, SEQ ID NO:942) or valencene synthase from *Vitis vinifera* (SEQ ID NO:346). CVS variants V240, V243, and V245 were used as templates to generate the mutants. Production of valencene was determined, and the results showed that the mutants resulted in reduced production of valencene compared to V19.

Example 7

Production of Nookatone

The valencene-containing soybean oil, produced by fermentation as described in Example 2, was concentrated and purified using wiped-film distillation at 100° C. and 350 mTorr to generate an oil that contained approximately 68% valencene by weight. This material was converted to nootkatone by two different methods described below.

A. Oxidation of Valencene to Nootkatone Using Chromium Trioxide

The valencene distillate produced as described above was oxidized to nootkatone using chromium trioxide and pyridine in dicholoromethane as follows. Chromium trioxide (369 g, 3.69 mol, 22 eq) was added in portions to a solution of pyridine (584 g, 7.4 mol, 44 eq) in 5 L of dicholoromethane. The mixture was stirred for 10 minutes, 50 grams of valencene distillate (68% w/w, 0.167 mol, 1 eq) was added over four minutes, and the mixture was stirred at 22° C. for 18 hours. The liquor was drained from the vessel, and the solids were washed twice with 2 L of methyl tert-butyl ether (MTBE). The combined organic layers were further diluted with 2 L of MTBE and successively washed three times with 1.25 L of 5% sodium hydroxide, twice with 2 L of 5% hydrochloric acid, and once with 2 L of brine. The organic phase was dried over 200 grams of anhydrous sodium sulfate, filtered, and concentrated by evaporation to give 36.8 grams crude nootkatone (48% w/w, 0.081 mol, 48% yield).

B. Oxidation of Valencene to Nootkatone Using Silica Phosphonate-Immobilized Chromium (III) Catalyst Silica phosphonate chromium (III) resin (48.9 g, PhosphonicS, Ltd.) was placed in a 5 L round bottom flask equipped with a condenser, thermowell, overhead stirrer, and sparge tube. Two (2) L of t-butanol and valencene distillate (68%, 500 g, 1.67 moles, 1 eq) were added, the contents were heated to 45° C., and the heterogeneous suspension was allowed to stir as oxygen was sparged through the solution (ca 1.5 L/min) and nitrogen flushed over the head-space. 70% t-butyl hydroperoxide in water (TBHP, 315 g, 2.45 moles, 1.47 eq) was added to the solution over 2 hrs while the temperature of the reaction was heated and maintained at 60±5° C. The reaction was allowed to stir until >90% of the valencene was consumed, as determined by gas chromatography. The reaction was then allowed to cool to room temperature and the silica catalyst removed by filtration. The flask and resin were washed with 500 mL isopropanol. One (1) L of deionized water was added to the combined organic solution (t-butanol and isopropanol), and the mixture was concentrated under reduced pressure by evaporation to afford an amber colored oil. The oil was dissolved in 3 L of toluene and washed with 3.125 L of 15% sulfuric acid for 15 minutes with vigorous agitation. The aqueous layer was removed and re-extracted with 1 L of toluene. The combined toluene layers were then washed three times with 2.5 L of 1 M sodium hydroxide, twice with 500 mL saturated sodium chloride, and dried over anhydrous magnesium sulfate. After filtration, the solvent was removed under reduced pressure by evaporation to afford 378 g of viscous amber oil (33% nootkatone by weight, 0.57 moles, 34% yield).

Example 8

Analysis of Terpene Product Distribution of CVS Variants

In this example, gas chromatography (GC) was used to determine the product distribution of the terpenes produced by the variant valencene synthases. Analysis of the products produced by yeast strains expressing valencene synthase by gas chromatography indicates that the enzyme produces valencene as the primary product. A number of byproducts, including compounds referred to as Peak 1 (tentatively identified as β-selinene), Peak 2 (tentatively identified as τ-selinene), Peak 3 (identified as eremophilene), Peak 4 (identified as 7-epi-α-selinene), and Peak 5 (unidentified), as well as β-elemene and a number of minor additional products were also produced. β-Elemene is almost certainly a degradation product of the mechanistic intermediate germacrene A, formed via Cope rearrangement (de Kraker et al. (2001) *Plant Physiol.* 125:1930-1940).

The results are shown in Tables 41 and 42 below, which set forth the distribution of terpene products, as a percentage of the total amount of terpenes produced, defined herein as the sum of the amounts of valencene, β-elemene, and Peaks 1 through 5, as measured by GC peak area. Table 41 below sets forth the distribution of products for variants CVS V19, V71, V73, V75, V229 and V231 (see Tables 19 and 27 above) produced from shake flask cultures. In variants V71, V73, and V75 the amount of valencene produced as a percentage of the total amount of terpenes was about 71%, as compared to 66% for variant CVS V19. A corresponding decrease in the amount of β-elemene formed in these variants was observed, suggesting that the variant enzymes were more efficient at pushing the reaction to completion rather than stopping at the germacrene A intermediate. Distribution of the remaining byproducts from the valencene synthase variants were similar between the variant enzymes. In variants V229 and V231, valencene again represented a larger proportion of the product mixture (72.8%) than was produced by variant CVS V19 (67.66%). With V229 and V231, decreases in the percentages of both β-elemene and Peak 3 were observed.

Table 42 below shows a similar comparison of yeast strains expressing valencene synthase variants grown in 3 L fermentation cultures. It was observed that the product distribution from variant CVS V19 was similar, but not identical, in fermentor cultivation to the product distribution seen in shake flask cultures. Variants V73 and V75 had altered product distributions leading to a larger percentage of the total product being represented by valencene. In each of these variants, the amount of β-elemene observed was less than that observed for variant CVS V19, again suggesting that the enzymes were more efficient at pushing the reaction to completion rather than stopping at intermediate germacrene A. The amounts of Peaks 1 through 4 produced by these variants were all similar to the CVS V19 variant. Interestingly, more of the Peak 5 compound was produced by variant V75 compared to variant CVS V19, but less Peak 5 product was produced by V73. This suggested that variations in culture conditions might also influence product distribution with respect to this unidentified byproduct.

TABLE 41

| Distribution of products generated by valencene synthase variants in shake flask cultures | | | | | | | |
|---|---|---|---|---|---|---|---|
| Enzyme variant | Valencene | β-Elemene | Peak 1 | Peak 2 | Peak 3 | Peak 4 | Peak 5 |
| Experiment 1 | | | | | | | |
| V19 | 66.09% | 8.24% | 1.66% | 5.93% | 3.56% | 8.58% | 5.94% |
| V71 | 71.3% | 3.23% | 1.62% | 6.09% | 3.32% | 8.51% | 5.93% |
| V73 | 71.71% | 3.02% | 1.56% | 6.13% | 3.23% | 8.41% | 5.95% |
| V75 | 70.86% | 3.89% | 1.73% | 6.10% | 3.38% | 8.23% | 5.8% |
| Experiment 2 | | | | | | | |
| V19 | 67.66% | 6.28% | 1.59% | 6.12% | 4.14% | 8.59% | 5.61% |
| V229 | 72.8% | 2.81% | 1.58% | 6.28% | 2.68% | 8.31% | 5.53% |
| V231 | 72.8% | 2.88% | 1.59% | 6.29% | 2.66% | 8.29% | 5.48% |

In general, it was observed that the proportion of products produced by some variant valencene synthase differ from those produced by the wild type enzyme or variants V18 and V19, whose product profiles are similar to the wild type valencene synthase. In particular, the proportion of valencene produced by some variants was higher than that observed in V19. These data indicated that variants with altered product selectivity can be produced by introducing mutations into valencene synthase and that some variants produce a greater proportion of valencene in the product mix.

TABLE 42

| Distribution of products generated by valencene synthase variants in 3 L fermentor cultures | | | | | | | |
|---|---|---|---|---|---|---|---|
| Enzyme variant | Valencene | β-Elemene | Peak 1 | Peak 2 | Peak 3 | Peak 4 | Peak 5 |
| V19 | 68.72% | 6.94% | 1.35% | 6.26% | 1.67% | 8.92% | 6.14% |
| V73 | 74.02% | 2.90% | 1.44% | 6.46% | 1.81% | 8.75% | 4.61% |
| V75 | 70.27% | 2.95% | 1.43% | 6.03% | 1.55% | 8.39% | 9.38% |

Example 9

Additional Valencene Synthase Mutants

Additional valencene synthase mutants were produced using a valencene synthase above as a template to introduce further amino acid replacements or swaps using error prone PCR and overlapping PCR methods similar to those described above using primers that introduce mutations at multiple codon positions simultaneously. For example, some additional mutants were generated using valencene synthase V19, V240 or V245 as the template in a PCR reaction or reactions using primers set forth in Table 25. The generated mutants were screened for valencene production as described above. The Table below set forth the generated variants, including amino acid and nucleotide changes versus both wildtype CVS and CVS V19, and valencene production % versus CVS V19.

CVS variants V293, V299, V300, V304, V305, V306, V307 and V308 were generated from V240 as a template sequence so that the variants have amino acids 53-58 replaced by amino acids 58-63 of TEAS (SEQ ID NO:941), amino acids 85-99 replaced by amino acids 93-110 of HPS (SEQ ID NO:942) and amino acids 174-184 replaced by amino acids 185-193 of HPS (SEQ ID NO:942) or 177-185 of TEAS (SEQ ID NO:941) as described above. In addition, the variants all were generated to contain one or more other amino acid replacements compared to V240 such as M1T, S2A, S3G, G4E, E5A, F7G, A11T, N20D, L23S, Y152H (Y152→H155), E163D (E163→D166), K173E (K173→E176), M210T (M210→T211), C361R(C361→R362), Q448L (Q448→L449), C465S(C465→S466), K468Q (K468→Q469), K499E(K499→E500), P500L (P500→L501) and/or A539V (A539→V540).

CVS variant V292 was generated from V245 as a template sequence so that the variant has amino acids 53-58 replaced by amino acids 58-63 of TEAS (SEQ ID NO:941), amino acids 85-99 replaced by amino acids 93-110 of HPS (SEQ ID NO:942), amino acids 174-184 replaced by amino acids 185-193 of HPS (SEQ ID NO:942) or 177-185 of TEAS (SEQ ID NO:941), and amino acids 212-221 were replaced by amino acids 223-230 of *Vitis* (SEQ ID NO:346) as described above. In addition, the variant was generated to contain an amino acid replacement V439L (V439→L438) compared to V245.

CVS variants V311 and V312 were generated from V19 as a template sequence. In addition, in the variants, amino acids 90-99 of CVS were replaced by amino acids 101-113 of *Vitis vinifera* set forth in SEQ ID NO:346 by direct yeast recombination as described above and using V19 as template (see Table 25). Mutagenic oligo 21-141.3 was used in a single PCR reaction with oligo 11-154.4 and mutagenic oligo 21-141.4 was used in a single PCR reaction with oligo 11-154.3, with oligos set forth in Table 25 above. V311 and V312 differ by two mutations, I82V and L399→S401 in V312.

In CVS variant V314, amino acids 3-41 were replaced by amino acids 3-51 of *Vitis* (SEQ ID NO:346), amino acids 53-58 were replaced by amino acids 58-63 of TEAS (SEQ ID NO:941), amino acids 85-99 were replaced by amino acids 96-112 of *Vitis* (SEQ ID NO:346) and amino acids 174-184 were replaced by amino acids 185-193 of HPS (SEQ ID NO:942) or 177-185 of TEAS (SEQ ID NO:941), and amino acids 212-221 were replaced by amino acids 223-230 of *Vitis* (SEQ ID NO:346) by direct yeast recombination as described above (see Table 25).

CVS variants V297 and V313 were generated using V240 or V314 as template, respectively, by replacing amino acids 115-146 by amino acids 128-159 of *Vitis vinifera* (SEQ ID NO:346). Three PCR fragments were combined by direct recombination as described above (see Table 25). The first PCR fragment used oligo 11-154.3 and mutagenic primer 21-145.30 with either V240 or V314 as template. The second PCR fragment used mutagenic primers 21-145.29 and 21-145.40 with *Vitis vinifera* (SEQ ID NO:346) as template. The third PCR fragment used oligo 11-154.4 and mutagenic oligo 21-145.39 with V240 as template. Thus, for CVS variant V313, in addition to the swaps described above for V314, in V313 amino acids 114-146 were replaced by amino acids 128-159 of *Vitis* (SEQ ID NO:346) by direct yeast recombination as described above (see Table 25). In addition, the variant was generated to contain an amino acid replacement H102Y (H102→Y114) compared to V314. CVS variant V297, which was generated from V240 as a template sequence, has amino acids 53-58 replaced by amino acids 58-63 of TEAS (SEQ ID NO:941), amino acids 85-99 replaced by amino acids 93-110 of HPS (SEQ ID NO:942), amino acids 114-146 replaced by amino acids 128-159 of *Vitis* (SEQ ID NO:346) and amino acids 174-184 replaced by amino acids 185-193 of HPS (SEQ ID NO:942) or 177-185 of TEAS (SEQ ID NO:941).

V260 (V259), V263 and V277 were used as templates to generate point mutations at amino acids 196, 197, 198, 200, 348 or 399 to generate CVS variants V287, V288, V289, V290, V294, V295, V296, V298, V301, V302, V303, V309, V310, V315. Some of the resulting identified mutations generated by the designed mutation strategy resulted in no differences from the template, silent mutations or reversions to wildtype sequence.

Each of the above variants, including amino acid and nucleotide changes versus both wildtype CVS and CVS V19, and valence production % versus CVS19 as assessed in shake flask cultures are set forth in Table 43. No data is provided for valencene production of variants V299, V300, V304, V305, V306, V307, V308 because these variants were tested only in microculture and not shake flask for valencene production.

TABLE 43

CVS Variants

| Mutant | Nucleotide changes vs. wildtype | Amino acid changes vs. wildtype | Nucleotide changes vs. CVS V19 | Amino acid changes vs. CVS V19 | SEQ ID NO nt | SEQ ID NO aa | Valencene production % vs. V19 (Shake Flask) |
|---|---|---|---|---|---|---|---|
| V287 | TCG→AAA | S2K | TCA→AAA | S2K | 945 | 944 | 75.8 |
| | TCT→GAA | S3E | TCT→GAA | S3E | | | |
| | GGA→TGT | G4C | GGT→TGT | G4C | | | |
| | GAA→ACG | E5T | GAA→ACG | E5T | | | |
| | ACA→ATG | T6M | ACT→ATG | T6M | | | |
| | TTT→TTA | F7L | TTT→TTA | F7L | | | |
| | AGA→AAA | R19K | AGA→AAA | R19K | | | |
| | AAA→CAA | K24Q | ACT→TTA | T53L | | | |
| | CAA→AAT | Q38N | GAT→GCA | D54A | | | |
| | ACA→TTA | T53L | GCA→ACC | A55T | | | |
| | GAT→GCA | D54A | GAA→GGA | E56G | | | |
| | GCT→ACC | A55T | GAT→AGG | D57R | | | |
| | GAA→GGA | E56G | CAA→AAA | Q58K | | | |
| | GAT→AGG | D57R | GCT→ATG | A85M | | | |
| | *AAG->AAA* | *K58K* | ATT→TTG | I86L | | | |
| | GTT→ATT | V60I | CAA→GAT | Q87D | | | |
| | GCA→ATG | A85M | CAA→CAC | Q88H | | | |
| | ATA→TTG | I86L | TTG→ATT | L89I | | | |
| | CAA→GAT | Q87D | TGT→TAC | C90Y | | | |
| | AAA→CAC | K88H | ---→AGA | ---→R91 | | | |
| | TTA→ATT | L89I | ---→GCT | ---→A92 | | | |
| | TGT→TAC | C90Y | ---→GAT | ---→D93 | | | |
| | ---→AGA | ---→R91 | *CCA→CCT* | *P91→P94* | | | |
| | ---→GCT | ---→A92 | ATT→TAT | I92→Y95 | | | |
| | ---→GAT | ---→D93 | CAT→TTT | H93→F96 | | | |
| | *CCA->CCT* | *P91->P94* | ATT→GAG | I94→E97 | | | |
| | ATC→TAT | I92→Y95 | GAT→GCT | D95→A98 | | | |
| | TAT→TTT | Y93→F96 | TCT→CAT | S96→H99 | | | |
| | ATT→GAG | I94→E97 | GAT→GAA | D97→E100 | | | |
| | GAC→GCT | D95→A98 | AAA→TAC | K98→Y101 | | | |
| | AGT→CAT | S96→H99 | GCT→AAT | A99→N102 | | | |
| | AAT→GAA | N97→E100 | *TTG→CTG* | *L161→L164* | | | |
| | AGA→TAC | R98→Y101 | *TCA→TCT* | *S174→S177* | | | |
| | GCT→AAT | A99→N102 | TTG→--- | L175→--- | | | |
| | AAG→CAA | K125→Q128 | GTT→--- | V176→--- | | | |
| | *TTA->CTG* | *L161->L164* | CAA→GCT | Q178→A179 | | | |
| | AAG→CAA | K173→Q176 | GAT→CCA | D179→P180 | | | |
| | *TCA->TCT* | *S174->S177* | GTT→TTG | V181→L182 | | | |
| | TTG→--- | L175→--- | ACT→AAG | T182→K183 | | | |
| | GTA→--- | V176→--- | CCA→TCA | P183→S184 | | | |
| | CAG→GCT | Q178→A179 | AGA→CCT | R184→P185 | | | |
| | GAT→CCA | D179→P180 | AGA→TCA | R212→S213 | | | |
| | GTA→TTG | V181→L182 | *ATT→ATC* | *I213→I214* | | | |
| | ACC→AAG | T182→K183 | GAT→TAT | D214→Y215 | | | |
| | CCT→TCA | P183→S184 | TCT→GAC | S215→D216 | | | |

TABLE 43-continued

CVS Variants

| Mutant | Nucleotide changes vs. wildtype | Amino acid changes vs. wildtype | Nucleotide changes vs. CVS V19 | Amino acid changes vs. CVS V19 | SEQ ID NO nt | SEQ ID NO aa | Valencene production % vs. V19 (Shake Flask) |
|---|---|---|---|---|---|---|---|
| | AAG→CCT | K184→P185 | ACT→AAG | T216→K217 | | | |
| | TTT→ATT | F209→I210 | TCT→--- | S217→--- | | | |
| | ATG→TCA | M212→S213 | GAT→GAA | D218E | | | |
| | AAT→TAT | N214→Y215 | GAT→CAA | D219Q | | | |
| | TCA→GAC | S215→D216 | TTG→TCG | L220S | | | |
| | ACA→AAG | T216→K217 | GTT→AAG | V221K | | | |
| | AGT→--- | S217→--- | *GGT→GGG* | *G276G* | | | |
| | GAT→GAA | D218E | CCA→TCA | P281S | | | |
| | CAT→CAA | H219Q | TTG→TGC | L313C | | | |
| | TTA→TCG | L220S | TCT→ACG | S314T | | | |
| | TAC→AAG | Y221K | TTG→ATG | L315M | | | |
| | GAG→GAT | E238D | ACC→AGT | T317S | | | |
| | AAA→CAA | K252Q | *GAC→GAT* | *D329D* | | | |
| | CCT→TCA | P281S | AAG→CGA | K336R | | | |
| | CAA→AAA | Q292K | TTA→ATT | L337I | | | |
| | CTC→TGC | L313C | *GAA→GAG* | *E348E* | | | |
| | AGC→ACG | S314T | GGT→CGG | G357R | | | |
| | CTC→ATG | L315M | *AAA→AAG* | *K468K* | | | |
| | ACT→AGT | T317S | GAG→GAT | E484D | | | |
| | CAA→GCT | Q321A | | | | | |
| | GAA→GAT | E333D | | | | | |
| | AAA→CGA | K336R | | | | | |
| | TTG→ATT | L337I | | | | | |
| | GCT→ACA | A345T | | | | | |
| | *GAA->GAG* | *E348E* | | | | | |
| | GGA→CGG | G357R | | | | | |
| | AAT→ATT | N369I | | | | | |
| | TCT→TAC | S377Y | | | | | |
| | ACA→AGA | T405R | | | | | |
| | AAT→GGT | N429G | | | | | |
| | GCA→TCT | A436S | | | | | |
| | GAA→GAT | E484D | | | | | |
| | ACC→CCA | T501P | | | | | |
| | GAT→GAA | D536E | | | | | |
| V288 | TCG→AAA | S2K | TCA→AAA | S2K | 947 | 946 | 92.4 |
| | TCT→GAA | S3E | TCT→GAA | S3E | | | |
| | GGA→TGT | G4C | GGT→TGT | G4C | | | |
| | GAA→ACG | E5T | GAA→ACG | E5T | | | |
| | ACA→ATG | T6M | ACT→ATG | T6M | | | |
| | TTT→TTA | F7L | TTT→TTA | F7L | | | |
| | AGA→AAA | R19K | AGA→AAA | R19K | | | |
| | AAA→CAA | K24Q | ACT→TTA | T53L | | | |
| | CAA→AAT | Q38N | GAT→GCA | D54A | | | |
| | ACA→TTA | T53L | GCA→ACC | A55T | | | |
| | GAT→GCA | D54A | GAA→GGA | E56G | | | |
| | GCT→ACC | A55T | GAT→AGG | D57R | | | |
| | GAA→GGA | E56G | CAA→AAA | Q58K | | | |
| | GAT→AGG | D57R | GCT→ATG | A85M | | | |
| | *AAG->AAA* | *K58K* | ATT→TTG | I86L | | | |
| | GTT→ATT | V60I | CAA→GAT | Q87D | | | |
| | GCA→ATG | A85M | CAA→CAC | Q88H | | | |
| | ATA→TTG | I86L | TTG→ATT | L89I | | | |
| | CAA→GAT | Q87D | TGT→TAC | C90Y | | | |
| | AAA→CAC | K88H | ---→AGA | ---→R91 | | | |
| | TTA→ATT | L89I | ---→GCT | ---→A92 | | | |
| | TGT→TAC | C90Y | ---→GAT | ---→D93 | | | |
| | ---→AGA | ---→R91 | *CCA→CCT* | *P91→P94* | | | |
| | ---→GCT | ---→A92 | ATT→TAT | I92→Y95 | | | |
| | ---→GAT | ---→D93 | CAT→TTT | H93→F96 | | | |
| | *CCA->CCT* | *P91->P94* | ATT→GAG | I94→E97 | | | |
| | ATC→TAT | I92→Y95 | GAT→GCT | D95→A98 | | | |
| | TAT→TTT | Y93→F96 | TCT→CAT | S96→H99 | | | |
| | ATT→GAG | I94→E97 | GAT→GAA | D97→E100 | | | |
| | GAC→GCT | D95→A98 | AAA→TAC | K98→Y101 | | | |
| | AGT→CAT | S96→H99 | GCT→AAT | A99→N102 | | | |
| | AAT→GAA | N97→E100 | *TCA→TCT* | *S174→S177* | | | |
| | AGA→TAC | R98→Y101 | TTG→--- | L175→--- | | | |
| | GCT→AAT | A99→N102 | GTT→--- | V176→--- | | | |
| | AAG→CAA | K125→Q128 | CAA→GCT | Q178→A179 | | | |
| | AAG→CAA | K173→Q176 | GAT→CCA | D179→P180 | | | |

TABLE 43-continued

CVS Variants

| Mutant | Nucleotide changes vs. wildtype | Amino acid changes vs. wildtype | Nucleotide changes vs. CVS V19 | Amino acid changes vs. CVS V19 | SEQ ID NO nt | SEQ ID NO aa | Valencene production % vs. V19 (Shake Flask) |
|---|---|---|---|---|---|---|---|
| | *TCA->TCT* | *S174->S177* | GTT→TTG | V181→L182 | | | |
| | TTG→--- | L175→--- | ACT→AAG | T182→K183 | | | |
| | GTA→--- | V176→--- | CCA→TCA | P183→S184 | | | |
| | CAG→GCT | Q178→A179 | AGA→CCT | R184→P185 | | | |
| | GAT→CCA | D179→P180 | AGA→TCA | R212→S213 | | | |
| | GTA→TTG | V181→L182 | *ATT→ATC* | *I213→I214* | | | |
| | ACC→AAG | T182→K183 | GAT→TAT | D214→Y215 | | | |
| | CCT→TCA | P183→S184 | TCT→GAC | S215→D216 | | | |
| | AAG→CCT | K184→P185 | ACT→AAG | T216→K217 | | | |
| | TTT→ATT | F209→I210 | TCT→--- | S217→--- | | | |
| | ATG→TCA | M212→S213 | GAT→GAA | D218E | | | |
| | AAT→TAT | N214→Y215 | GAT→CAA | D219Q | | | |
| | TCA→GAC | S215→D216 | TTG→TCG | L220S | | | |
| | ACA→AAG | T216→K217 | GTT→AAG | V221K | | | |
| | AGT→--- | S217→--- | *GGT→GGG* | *G276G* | | | |
| | GAT→GAA | D218E | CCA→TCA | P281S | | | |
| | CAT→CAA | H219Q | TTG→TGC | L313C | | | |
| | TTA→TCG | L220S | TCT→GCG | S314A | | | |
| | TAC→AAG | Y221K | TTG→ATG | L315M | | | |
| | GAG→GAT | E238D | ACC→AGT | T317S | | | |
| | AAA→CAA | K252Q | *GAC→GAT* | *D329D* | | | |
| | CCT→TCA | P281S | AAG→CGA | K336R | | | |
| | CAA→AAA | Q292K | TTA→ATT | L337I | | | |
| | CTC→TGC | L313C | GAA→GCT | E348A | | | |
| | AGC→GCG | S314A | GGT→CGG | G357R | | | |
| | CTC→ATG | L315M | *AAA→AAG* | *K468K* | | | |
| | ACT→AGT | T317S | GAG→GAT | E484D | | | |
| | CAA→GCT | Q321A | | | | | |
| | GAA→GAT | E333D | | | | | |
| | AAA→CGA | K336R | | | | | |
| | TTG→ATT | L337I | | | | | |
| | GCT→ACA | A345T | | | | | |
| | GAA→GCT | E348A | | | | | |
| | GGA→CGG | G357R | | | | | |
| | AAT→ATT | N369I | | | | | |
| | TCT→TAC | S377Y | | | | | |
| | ACA→AGA | T405R | | | | | |
| | AAT→GGT | N429G | | | | | |
| | GCA→TCT | A436S | | | | | |
| | GAA→GAT | E484D | | | | | |
| | ACC→CCA | T501P | | | | | |
| | GAT→GAA | D536E | | | | | |
| V289 | TCG→TGC | S2C | TCA→TGC | S2C | 949 | 948 | 83.2 |
| | TCT→ATG | S3M | TCT→ATG | S3M | | | |
| | GGA→ACA | G4T | GGT→ACA | G4T | | | |
| | GAA→GGT | E5G | GAA→GGT | E5G | | | |
| | ACA→GAA | T6E | ACT→GAA | T6E | | | |
| | TTT→TCG | F7S | TTT→TCG | F7S | | | |
| | AGA→AAA | R19K | AGA→AAA | R19K | | | |
| | AAA→CAA | K24Q | ACT→TTA | T53L | | | |
| | CAA→AAT | Q38N | GAT→GCA | D54A | | | |
| | ACA→TTA | T53L | GCA→ACC | A55T | | | |
| | GAT→GCA | D54A | GAA→GGA | E56G | | | |
| | GCT→ACC | A55T | GAT→AGG | D57R | | | |
| | GAA→GGA | E56G | CAA→AAA | Q58K | | | |
| | GAT→AGG | D57R | GCT→ATG | A85M | | | |
| | *AAG->AAA* | *K58K* | ATT→TTG | I86L | | | |
| | GTT→ATT | V60I | CAA→GAT | Q87D | | | |
| | GCA→ATG | A85M | CAA→CAC | Q88H | | | |
| | ATA→TTG | I86L | TTG→ATT | L89I | | | |
| | CAA→GAT | Q87D | TGT→TAC | C90Y | | | |
| | AAA→CAC | K88H | ---→AGA | ---→R91 | | | |
| | TTA→ATT | L89I | ---→GCT | ---→A92 | | | |
| | TGT→TAC | C90Y | ---→GAT | ---→D93 | | | |
| | ---→AGA | ---→R91 | *CCA→CCT* | *P91→P94* | | | |
| | ---→GCT | ---→A92 | ATT→TAT | I92→Y95 | | | |
| | ---→GAT | ---→D93 | CAT→TTT | H93→F96 | | | |
| | *CCA->CCT* | *P91->P94* | ATT→GAG | I94→E97 | | | |
| | ATC→TAT | I92→Y95 | GAT→GCT | D95→A98 | | | |
| | TAT→TTT | Y93→F96 | TCT→CAT | S96→H99 | | | |

TABLE 43-continued

CVS Variants

| Mutant | Nucleotide changes vs. wildtype | Amino acid changes vs. wildtype | Nucleotide changes vs. CVS V19 | Amino acid changes vs. CVS V19 | SEQ ID NO nt | SEQ ID NO aa | Valencene production % vs. V19 (Shake Flask) |
|---|---|---|---|---|---|---|---|
| | ATT→GAG | I94→E97 | GAT→GAA | D97→E100 | | | |
| | GAC→GCT | D95→A98 | AAA→TAC | K98→Y101 | | | |
| | AGT→CAT | S96→H99 | GCT→AAT | A99→N102 | | | |
| | AAT→GAA | N97→E100 | *TCA→TCT* | *S174→S177* | | | |
| | AGA→TAC | R98→Y101 | TTG→--- | L175→--- | | | |
| | GCT→AAT | A99→N102 | GTT→--- | V176→--- | | | |
| | AAG→CAA | K125→Q128 | CAA→GCT | Q178→A179 | | | |
| | AAG→CAA | K173→Q176 | GAT→CCA | D179→P180 | | | |
| | *TCA->TCT* | *S174->S177* | GTT→TTG | V181→L182 | | | |
| | TTG→--- | L175→--- | ACT→AAG | T182→K183 | | | |
| | GTA→--- | V176→--- | CCA→TCA | P183→S184 | | | |
| | CAG→GCT | Q178→A179 | AGA→CCT | R184→P185 | | | |
| | GAT→CCA | D179→P180 | *TTG→CTG* | *L197→L198* | | | |
| | GTA→TTG | V181→L182 | *TCA→TCG* | *S211→S212* | | | |
| | ACC→AAG | T182→K183 | AGA→TCA | R212→S213 | | | |
| | CCT→TCA | P183→S184 | *ATT→ATC* | *I213→I214* | | | |
| | AAG→CCT | K184→P185 | GAT→TAT | D214→Y215 | | | |
| | *CTT->CTG* | *L197->L198* | TCT→GAC | S215→D216 | | | |
| | TTT→ATT | F209→I210 | ACT→AAG | T216→K217 | | | |
| | *TCC->TCG* | *S211->S212* | TCT→--- | S217→--- | | | |
| | ATG→TCA | M212→S213 | GAT→GAA | D218E | | | |
| | AAT→TAT | N214→Y215 | GAT→CAA | D219Q | | | |
| | TCA→GAC | S215→D216 | TTG→TCG | L220S | | | |
| | ACA→AAG | T216→K217 | GTT→AAG | V221K | | | |
| | AGT→--- | S217→--- | *GGT→GGG* | *G276G* | | | |
| | GAT→GAA | D218E | CCA→TCA | P281S | | | |
| | CAT→CAA | H219Q | TTG→TGC | L313C | | | |
| | TTA→TCG | L220S | TCT→ACG | S314T | | | |
| | TAC→AAG | Y221K | TTG→ATG | L315M | | | |
| | GAG→GAT | E238D | ACC→AGT | T317S | | | |
| | AAA→CAA | K252Q | *GAC→GAT* | *D329D* | | | |
| | CCT→TCA | P281S | AAG→CGA | K336R | | | |
| | CAA→AAA | Q292K | TTA→ATT | L337I | | | |
| | CTC→TGC | L313C | GGT→CGG | G357R | | | |
| | AGC→ACG | S314T | GAG→GAT | E484D | | | |
| | CTC→ATG | L315M | | | | | |
| | ACT→AGT | T317S | | | | | |
| | CAA→GCT | Q321A | | | | | |
| | GAA→GAT | E333D | | | | | |
| | AAA→CGA | K336R | | | | | |
| | TTG→ATT | L337I | | | | | |
| | GCT→ACA | A345T | | | | | |
| | GGA→CGG | G357R | | | | | |
| | AAT→ATT | N369I | | | | | |
| | TCT→TAC | S377Y | | | | | |
| | ACA→AGA | T405R | | | | | |
| | AAT→GGT | N429G | | | | | |
| | GCA→TCT | A436S | | | | | |
| | GAA→GAT | E484D | | | | | |
| | ACC→CCA | T501P | | | | | |
| | GAT→GAA | D536E | | | | | |
| V290 | TCG→TGC | S2C | TCA→TGC | S2C | 951 | 950 | 88.5 |
| | TCT→ATG | S3M | TCT→ATG | S3M | | | |
| | GGA→ACA | G4T | GGT→ACA | G4T | | | |
| | GAA→GGT | E5G | GAA→GGT | E5G | | | |
| | ACA→GAA | T6E | ACT→GAA | T6E | | | |
| | TTT→TCG | F7S | TTT→TCG | F7S | | | |
| | AGA→AAA | R19K | AGA→AAA | R19K | | | |
| | AAA→CAA | K24Q | ACT→TTA | T53L | | | |
| | CAA→AAT | Q38N | GAT→GCA | D54A | | | |
| | ACA→TTA | T53L | GCA→ACC | A55T | | | |
| | GAT→GCA | D54A | GAA→GGA | E56G | | | |
| | GCT→ACC | A55T | GAT→AGG | D57R | | | |
| | GAA→GGA | E56G | CAA→AAA | Q58K | | | |
| | GAT→AGG | D57R | GCT→ATG | A85M | | | |
| | *AAG->AAA* | *K58K* | ATT→TTG | I86L | | | |
| | GTT→ATT | V60I | CAA→GAT | Q87D | | | |
| | GCA→ATG | A85M | CAA→CAC | Q88H | | | |
| | ATA→TTG | I86L | TTG→ATT | L89I | | | |
| | CAA→GAT | Q87D | TGT→TAC | C90Y | | | |

TABLE 43-continued

CVS Variants

| Mutant | Nucleotide changes vs. wildtype | Amino acid changes vs. wildtype | Nucleotide changes vs. CVS V19 | Amino acid changes vs. CVS V19 | SEQ ID NO nt | SEQ ID NO aa | Valencene production % vs. V19 (Shake Flask) |
|---|---|---|---|---|---|---|---|
| | AAA→CAC | K88H | ---→AGA | ---→R91 | | | |
| | TTA→ATT | L89I | ---→GCT | ---→A92 | | | |
| | TGT→TAC | C90Y | ---→GAT | ---→D93 | | | |
| | ---→AGA | ---→R91 | *CCA→CCT* | *P91→P94* | | | |
| | ---→GCT | ---→A92 | ATT→TAT | I92→Y95 | | | |
| | ---→GAT | ---→D93 | CAT→TTT | H93→F96 | | | |
| | *CCA->CCT* | *P91->P94* | ATT→GAG | I94→E97 | | | |
| | ATC→TAT | I92→Y95 | GAT→GCT | D95→A98 | | | |
| | TAT→TTT | Y93→F96 | TCT→CAT | S96→H99 | | | |
| | ATT→GAG | I94→E97 | GAT→GAA | D97→E100 | | | |
| | GAC→GCT | D95→A98 | AAA→TAC | K98→Y101 | | | |
| | AGT→CAT | S96→H99 | GCT→AAT | A99→N102 | | | |
| | AAT→GAA | N97→E100 | *TCA→TCT* | *S174→S177* | | | |
| | AGA→TAC | R98→Y101 | TTG→--- | L175→--- | | | |
| | GCT→AAT | A99→N102 | GTT→--- | V176→--- | | | |
| | AAG→CAA | K125→Q128 | CAA→GCT | Q178→A179 | | | |
| | AAG→CAA | K173→Q176 | GAT→CCA | D179→P180 | | | |
| | *TCA->TCT* | *S174->S177* | GTT→TTG | V181→L182 | | | |
| | TTG→--- | L175→--- | ACT→AAG | T182→K183 | | | |
| | GTA→--- | V176→--- | CCA→TCA | P183→S184 | | | |
| | CAG→GCT | Q178→A179 | AGA→CCT | R184→P185 | | | |
| | GAT→CCA | D179→P180 | *AGA→CGT* | *R198→R199* | | | |
| | GTA→TTG | V181→L182 | AGA→TCA | R212→S213 | | | |
| | ACC→AAG | T182→K183 | *ATT→ATC* | *I213→I214* | | | |
| | CCT→TCA | P183→S184 | GAT→TAT | D214→Y215 | | | |
| | AAG→CCT | K184→P185 | TCT→GAC | S215→D216 | | | |
| | TTT→ATT | F209→I210 | ACT→AAG | T216→K217 | | | |
| | ATG→TCA | M212→S213 | TCT→--- | S217→--- | | | |
| | AAT→TAT | N214→Y215 | GAT→GAA | D218E | | | |
| | TCA→GAC | S215→D216 | GAT→CAA | D219Q | | | |
| | ACA→AAG | T216→K217 | TTG→TCG | L220S | | | |
| | AGT→--- | S217→--- | GTT→AAG | V221K | | | |
| | GAT→GAA | D218E | *GGT→GGG* | *G276G* | | | |
| | CAT→CAA | H219Q | CCA→TCA | P281S | | | |
| | TTA→TCG | L220S | TTG→TGC | L313C | | | |
| | TAC→AAG | Y221K | TCT→ACG | S314T | | | |
| | GAG→GAT | E238D | TTG→ATG | L315M | | | |
| | AAA→CAA | K252Q | ACC→AGT | T317S | | | |
| | CCT→TCA | P281S | *GAC→GAT* | *D329D* | | | |
| | CAA→AAA | Q292K | AAG→CGA | K336R | | | |
| | CTC→TGC | L313C | TTA→ATT | L337I | | | |
| | AGC→ACG | S314T | GGT→CGG | G357R | | | |
| | CTC→ATG | L315M | GAG→GAT | E484D | | | |
| | ACT→AGT | T317S | | | | | |
| | CAA→GCT | Q321A | | | | | |
| | GAA→GAT | E333D | | | | | |
| | AAA→CGA | K336R | | | | | |
| | TTG→ATT | L337I | | | | | |
| | GCT→ACA | A345T | | | | | |
| | GGA→CGG | G357R | | | | | |
| | AAT→ATT | N369I | | | | | |
| | TCT→TAC | S377Y | | | | | |
| | ACA→AGA | T405R | | | | | |
| | AAT→GGT | N429G | | | | | |
| | GCA→TCT | A436S | | | | | |
| | GAA→GAT | E484D | | | | | |
| | ACC→CCA | T501P | | | | | |
| | GAT→GAA | D536E | | | | | |
| V292 | AGA→AAA | R19K | AGA→AAA | R19K | 953 | 952 | 57.2 |
| | AAA→CAA | K24Q | ACT→TTA | T53L | | | |
| | CAA→AAT | Q38N | GAT→GCA | D54A | | | |
| | ACA→TTA | T53L | GCA→ACC | A55T | | | |
| | GAT→GCA | D54A | GAA→GGA | E56G | | | |
| | GCT→ACC | A55T | GAT→AGG | D57R | | | |
| | GAA→GGA | E56G | CAA→AAA | Q58K | | | |
| | GAT→AGG | D57R | GCT→ATG | A85M | | | |
| | *AAG->AAA* | *K58K* | ATT→TTG | I86L | | | |
| | GTT→ATT | V60I | CAA→GAT | Q87D | | | |
| | GCA→ATG | A85M | CAA→CAC | Q88H | | | |
| | ATA→TTG | I86L | TTG→ATT | L89I | | | |

TABLE 43-continued

CVS Variants

| Mutant | Nucleotide changes vs. wildtype | Amino acid changes vs. wildtype | Nucleotide changes vs. CVS V19 | Amino acid changes vs. CVS V19 | SEQ ID NO nt | SEQ ID NO aa | Valencene production % vs. V19 (Shake Flask) |
|---|---|---|---|---|---|---|---|
| | CAA→GAT | Q87D | TGT→TAC | C90Y | | | |
| | AAA→CAC | K88H | ---→AGA | ---→R91 | | | |
| | TTA→ATT | L89I | ---→GCT | ---→A92 | | | |
| | TGT→TAC | C90Y | ---→GAT | ---→D93 | | | |
| | ---→AGA | ---→R91 | *CCA→CCT* | *P91→P94* | | | |
| | ---→GCT | ---→A92 | ATT→TAT | I92→Y95 | | | |
| | ---→GAT | ---→D93 | CAT→TTT | H93→F96 | | | |
| | *CCA->CCT* | *P91->P94* | ATT→GAG | I94→E97 | | | |
| | ATC→TAT | I92→Y95 | GAT→GCT | D95→A98 | | | |
| | TAT→TTT | Y93→F96 | TCT→CAT | S96→H99 | | | |
| | ATT→GAG | I94→E97 | GAT→GAA | D97→E100 | | | |
| | GAC→GCT | D95→A98 | AAA→TAC | K98→Y101 | | | |
| | AGT→CAT | S96→H99 | GCT→AAT | A99→N102 | | | |
| | AAT→GAA | N97→E100 | *TCA→TCT* | *S174→S177* | | | |
| | AGA→TAC | R98→Y101 | TTG→--- | L175→--- | | | |
| | GCT→AAT | A99→N102 | GTT→--- | V176→--- | | | |
| | AAG→CAA | K125→Q128 | CAA→GCT | Q178→A179 | | | |
| | AAG→CAA | K173→Q176 | GAT→CCG | D179→P180 | | | |
| | *TCA->TCT* | *S174->S177* | GTT→TTG | V181→L182 | | | |
| | TTG→--- | L175→--- | ACT→AAG | T182→K183 | | | |
| | GTA→--- | V176→--- | CCA→TCA | P183→S184 | | | |
| | CAG→GCT | Q178→A179 | AGA→CCT | R184→P185 | | | |
| | GAT→CCG | D179→P180 | *GCT→GCA* | *A192→A193* | | | |
| | GTA→TTG | V181→L182 | AGA→GTC | R212→V213 | | | |
| | ACC→AAG | T182→K183 | ATT→TAC | I213→Y214 | | | |
| | CCT→TCA | P183→S184 | GAT→--- | D214→--- | | | |
| | AAG→CCT | K184→P185 | TCT→--- | S215→--214 | | | |
| | *GCT->GCA* | *A192->A193* | ACT→CAA | T216→Q215 | | | |
| | TTT→ATT | F209→I210 | TCT→GAT | S217→D216 | | | |
| | ATG→GTC | M212→V213 | GAT→GAA | D218→E217 | | | |
| | ATC→TAC | I213→Y214 | GAT→GCT | D219→A218 | | | |
| | AAT→--- | N214→--- | TTG→TTC | L220→F219 | | | |
| | TCA→--- | S215→--214 | GTT→CAT | V221→H220 | | | |
| | ACA→CAA | T216→Q215 | *GGT→GGG* | *G276→G275* | | | |
| | AGT→GAT | S217→D216 | CCA→TCA | P281→S280 | | | |
| | GAT→GAA | D218→E217 | TTG→TGC | L313→C312 | | | |
| | CAT→GCT | H219→A218 | TCT→ACG | S314→T313 | | | |
| | TTA→TTC | L220→F219 | TTG→ATG | L315→M314 | | | |
| | TAC→CAT | Y221→H220 | ACC→AGT | T317→S316 | | | |
| | GAG→GAT | E238→D237 | *GAC→GAT* | *D329→D328* | | | |
| | AAA→CAA | K252→Q251 | AAG→CGA | K336→R335 | | | |
| | CCT→TCA | P281→S280 | TTA→ATT | L337→I336 | | | |
| | CAA→AAA | Q292→K291 | GGT→CGG | G357→R356 | | | |
| | CTC→TGC | L313→C312 | GTT→CTT | V439→L438 | | | |
| | AGC→ACG | S314→T313 | GAG→GAT | E484→D483 | | | |
| | CTC→ATG | L315→M314 | | | | | |
| | ACT→AGT | T317→S316 | | | | | |
| | CAA→GCT | Q321→A320 | | | | | |
| | GAA→GAT | E333→D332 | | | | | |
| | AAA→CGA | K336→R335 | | | | | |
| | TTG→ATT | L337→I336 | | | | | |
| | GCT→ACA | A345→T344 | | | | | |
| | GGA→CGG | G357→R356 | | | | | |
| | AAT→ATT | N369→I368 | | | | | |
| | TCT→TAC | S377→Y376 | | | | | |
| | ACA→AGA | T405→R404 | | | | | |
| | AAT→GGT | N429→G428 | | | | | |
| | GCA→TCT | A436→S435 | | | | | |
| | GTT→CTT | V439→L438 | | | | | |
| | GAA→GAT | E484→D483 | | | | | |
| | ACC→CCA | T501→P500 | | | | | |
| | GAT→GAA | D536→E535 | | | | | |
| V293 | TCG→GCT | S2A | TCA→GCT | S2A | 955 | 954 | 73.7 |
| | TCT→GGA | S3G | TCT→GGA | S3G | | | |
| | GGA→GAG | G4E | GGT→GAG | G4E | | | |
| | GAA→GCG | E5A | GAA→GCG | E5A | | | |
| | TTT→GGA | F7G | *ACT→ACA* | *T6T* | | | |
| | AGA→AAA | R19K | TTT→GGA | F7G | | | |
| | AAA→CAA | K24Q | AGA→AAA | R19K | | | |
| | CAA→AAT | Q38N | ACT→TTA | T53L | | | |

TABLE 43-continued

CVS Variants

| Mutant | Nucleotide changes vs. wildtype | Amino acid changes vs. wildtype | Nucleotide changes vs. CVS V19 | Amino acid changes vs. CVS V19 | SEQ ID NO nt | SEQ ID NO aa | Valencene production % vs. V19 (Shake Flask) |
|---|---|---|---|---|---|---|---|
| | ACA→TTA | T53L | GAT→GCA | D54A | | | |
| | GAT→GCA | D54A | GCA→ACC | A55T | | | |
| | GCT→ACC | A55T | GAA→GGA | E56G | | | |
| | GAA→GGA | E56G | GAT→AGG | D57R | | | |
| | GAT→AGG | D57R | CAA→AAA | Q58K | | | |
| | *AAG->AAA* | *K58K* | GCT→ATG | A85M | | | |
| | GTT→ATT | V60I | ATT→TTG | I86L | | | |
| | GCA→ATG | A85M | CAA→GAT | Q87D | | | |
| | ATA→TTG | I86L | CAA→CAC | Q88H | | | |
| | CAA→GAT | Q87D | TTG→ATT | L89I | | | |
| | AAA→CAC | K88H | TGT→TAC | C90Y | | | |
| | TTA→ATT | L89I | ---→AGA | ---→R91 | | | |
| | TGT→TAC | C90Y | ---→GCT | ---→A92 | | | |
| | ---→AGA | ---→R91 | ---→GAT | ---→D93 | | | |
| | ---→GCT | ---→A92 | *CCA→CCT* | *P91→P94* | | | |
| | ---→GAT | ---→D93 | ATT→TAT | I92→Y95 | | | |
| | *CCA->CCT* | *P91->P94* | CAT→TTT | H93→F96 | | | |
| | ATC→TAT | I92→Y95 | ATT→GAG | I94→E97 | | | |
| | TAT→TTT | Y93→F96 | GAT→GCT | D95→A98 | | | |
| | ATT→GAG | I94→E97 | TCT→CAT | S96→H99 | | | |
| | GAC→GCT | D95→A98 | GAT→GAA | D97→E100 | | | |
| | AGT→CAT | S96→H99 | AAA→TAC | K98→Y101 | | | |
| | AAT→GAA | N97→E100 | GCT→AAT | A99→N102 | | | |
| | AGA→TAC | R98→Y101 | *TCA→TCT* | *S174→S177* | | | |
| | GCT→AAT | A99→N102 | TTG→--- | L175→--- | | | |
| | AAG→CAA | K125→Q128 | GTT→--- | V176→--- | | | |
| | AAG→CAA | K173→Q176 | CAA→GCT | Q178→A179 | | | |
| | *TCA->TCT* | *S174->S177* | GAT→CCA | D179→P180 | | | |
| | TTG→--- | L175→--- | GTT→TTG | V181→L182 | | | |
| | GTA→--- | V176→--- | ACT→AAG | T182→K183 | | | |
| | CAG→GCT | Q178→A179 | CCA→TCA | P183→S184 | | | |
| | GAT→CCA | D179→P180 | AGA→CCT | R184→P185 | | | |
| | GTA→TTG | V181→L182 | *GAA→GAG* | *E205→E206* | | | |
| | ACC→AAG | T182→K183 | *GGT→GGG* | *G276→G277* | | | |
| | CCT→TCA | P183→S184 | CCA→TCA | P281→S282 | | | |
| | AAG→CCT | K184→P185 | TTG→TGC | L313→C314 | | | |
| | TTT→ATT | F209→I210 | TCT→ACG | S314→T315 | | | |
| | ATG→AGA | M212→R213 | TTG→ATG | L315→M316 | | | |
| | AAT→GAT | N214→D215 | ACC→AGT | T317→S318 | | | |
| | CAT→GAT | H219→D220 | *GAC→GAT* | *D329→D330* | | | |
| | TAC→GTT | Y221→V222 | AAG→CGA | K336→R337 | | | |
| | GAG→GAT | E238→D239 | TTA→ATT | L337→I338 | | | |
| | AAA→CAA | K252→Q253 | GGT→CGG | G357→R358 | | | |
| | CCT→TCA | P281→S282 | GAG→GAT | E484→D485 | | | |
| | CAA→AAA | Q292→K293 | AAA→GAA | K499→E500 | | | |
| | CTC→TGC | L313→C314 | | | | | |
| | AGC→ACG | S314→T315 | | | | | |
| | CTC→ATG | L315→M316 | | | | | |
| | ACT→AGT | T317→S318 | | | | | |
| | CAA→GCT | Q321→A322 | | | | | |
| | GAA→GAT | E333→D334 | | | | | |
| | AAA→CGA | K336→R337 | | | | | |
| | TTG→ATT | L337→I338 | | | | | |
| | GCT→ACA | A345→T346 | | | | | |
| | GGA→CGG | G357→R358 | | | | | |
| | AAT→ATT | N369→I370 | | | | | |
| | TCT→TAC | S377→Y378 | | | | | |
| | ACA→AGA | T405→R406 | | | | | |
| | AAT→GGT | N429→G430 | | | | | |
| | GCA→TCT | A436→S437 | | | | | |
| | GAA→GAT | E484→D485 | | | | | |
| | AAG→GAA | K499→E500 | | | | | |
| | ACC→CCA | T501→P502 | | | | | |
| | GAT→GAA | D536→E537 | | | | | |
| V294 | TCG→TGC | S2C | TCA→TGC | S2C | 957 | 956 | 79.3 |
| | TCT→ATG | S3M | TCT→ATG | S3M | | | |
| | GGA→ACA | G4T | GGT→ACA | G4T | | | |
| | GAA→GGT | E5G | GAA→GGT | E5G | | | |
| | ACA→GAA | T6E | ACT→GAA | T6E | | | |
| | TTT→TCG | F7S | TTT→TCG | F7S | | | |

TABLE 43-continued

CVS Variants

| Mutant | Nucleotide changes vs. wildtype | Amino acid changes vs. wildtype | Nucleotide changes vs. CVS V19 | Amino acid changes vs. CVS V19 | SEQ ID NO nt | SEQ ID NO aa | Valencene production % vs. V19 (Shake Flask) |
|---|---|---|---|---|---|---|---|
| | AGA→AAA | R19K | AGA→AAA | R19K | | | |
| | AAA→CAA | K24Q | ACT→TTA | T53L | | | |
| | CAA→AAT | Q38N | GAT→GCA | D54A | | | |
| | ACA→TTA | T53L | GCA→ACC | A55T | | | |
| | GAT→GCA | D54A | GAA→GGA | E56G | | | |
| | GCT→ACC | A55T | GAT→AGG | D57R | | | |
| | GAA→GGA | E56G | CAA→AAA | Q58K | | | |
| | GAT→AGG | D57R | GCT→ATG | A85M | | | |
| | *AAG->AAA* | *K58K* | ATT→TTG | I86L | | | |
| | GTT→ATT | V60I | CAA→GAT | Q87D | | | |
| | GCA→ATG | A85M | CAA→CAC | Q88H | | | |
| | ATA→TTG | I86L | TTG→ATT | L89I | | | |
| | CAA→GAT | Q87D | TGT→TAC | C90Y | | | |
| | AAA→CAC | K88H | ---→AGA | ---→R91 | | | |
| | TTA→ATT | L89I | ---→GCT | ---→A92 | | | |
| | TGT→TAC | C90Y | ---→GAT | ---→D93 | | | |
| | ---→AGA | ---→R91 | *CCA→CCT* | *P91→P94* | | | |
| | ---→GCT | ---→A92 | ATT→TAT | I92→Y95 | | | |
| | ---→GAT | ---→D93 | CAT→TTT | H93→F96 | | | |
| | *CCA->CCT* | *P91->P94* | ATT→GAG | I94→E97 | | | |
| | ATC→TAT | I92→Y95 | GAT→GCT | D95→A98 | | | |
| | TAT→TTT | Y93→F96 | TCT→CAT | S96→H99 | | | |
| | ATT→GAG | I94→E97 | GAT→GAA | D97→E100 | | | |
| | GAC→GCT | D95→A98 | AAA→TAC | K98→Y101 | | | |
| | AGT→CAT | S96→H99 | GCT→AAT | A99→N102 | | | |
| | AAT→GAA | N97→E100 | *TCA→TCT* | *S174→S177* | | | |
| | AGA→TAC | R98→Y101 | TTG→--- | L175→--- | | | |
| | GCT→AAT | A99→N102 | GTT→--- | V176→--- | | | |
| | AAG→CAA | K125→Q128 | CAA→GCT | Q178→A179 | | | |
| | AAG→CAA | K173→Q176 | GAT→CCA | D179→P180 | | | |
| | *TCA->TCT* | *S174->S177* | GTT→TTG | V181→L182 | | | |
| | TTG→--- | L175→--- | ACT→AAG | T182→K183 | | | |
| | GTA→--- | V176→--- | CCA→TCA | P183→S184 | | | |
| | CAG→GCT | Q178→A179 | AGA→CCT | R184→P185 | | | |
| | GAT→CCA | D179→P180 | CCA→CCC | P196→P197 | | | |
| | GTA→TTG | V181→L182 | AGA→TCA | R212→S213 | | | |
| | ACC→AAG | T182→K183 | *ATT→ATC* | *I213→I214* | | | |
| | CCT→TCA | P183→S184 | GAT→TAT | D214→Y215 | | | |
| | AAG→CCT | K184→P185 | TCT→GAC | S215→D216 | | | |
| | *CCT->CCC* | *P196->P197* | ACT→AAG | T216→K217 | | | |
| | TTT→ATT | F209→I210 | TCT→--- | S217→--- | | | |
| | ATG→TCA | M212→S213 | GAT→GAA | D218E | | | |
| | AAT→TAT | N214→Y215 | GAT→CAA | D219Q | | | |
| | TCA→GAC | S215→D216 | TTG→TCG | L220S | | | |
| | ACA→AAG | T216→K217 | GTT→AAG | V221K | | | |
| | AGT→--- | S217→--- | *GGT→GGG* | *G276G* | | | |
| | GAT→GAA | D218E | CCA→TCA | P281S | | | |
| | CAT→CAA | H219Q | TTG→TGC | L313C | | | |
| | TTA→TCG | L220S | TCT→ACG | S314T | | | |
| | TAC→AAG | Y221K | TTG→ATG | L315M | | | |
| | GAG→GAT | E238D | ACC→AGT | T317S | | | |
| | AAA→CAA | K252Q | *GAC→GAT* | *D329D* | | | |
| | CCT→TCA | P281S | AAG→CGA | K336R | | | |
| | CAA→AAA | Q292K | TTA→ATT | L337I | | | |
| | CTC→TGC | L313C | GGT→CGG | G357R | | | |
| | AGC→ACG | S314T | *CAA→CAG* | *Q448Q* | | | |
| | CTC→ATG | L315M | GAG→GAT | E484D | | | |
| | ACT→AGT | T317S | | | | | |
| | CAA→GCT | Q321A | | | | | |
| | GAA→GAT | E333D | | | | | |
| | AAA→CGA | K336R | | | | | |
| | TTG→ATT | L337I | | | | | |
| | GCT→ACA | A345T | | | | | |
| | GGA→CGG | G357R | | | | | |
| | AAT→ATT | N369I | | | | | |
| | TCT→TAC | S377Y | | | | | |
| | ACA→AGA | T405R | | | | | |
| | AAT→GGT | N429G | | | | | |
| | GCA→TCT | A436S | | | | | |
| | *CAA->CAG* | *Q448Q* | | | | | |
| | GAA→GAT | E484D | | | | | |

TABLE 43-continued

CVS Variants

| Mutant | Nucleotide changes vs. wildtype | Amino acid changes vs. wildtype | Nucleotide changes vs. CVS V19 | Amino acid changes vs. CVS V19 | SEQ ID NO nt | SEQ ID NO aa | Valencene production % vs. V19 (Shake Flask) |
|---|---|---|---|---|---|---|---|
| | ACC→CCA | T501P | | | | | |
| | GAT→GAA | D536E | | | | | |
| V295 | TCG→AAA | S2K | TCA→AAA | S2K | 959 | 958 | 81.6 |
| | TCT→GAA | S3E | TCT→GAA | S3E | | | |
| | GGA→TGT | G4C | GGT→TGT | G4C | | | |
| | GAA→ACG | E5T | GAA→ACG | E5T | | | |
| | ACA→ATG | T6M | ACT→ATG | T6M | | | |
| | TTT→TTA | F7L | TTT→TTA | F7L | | | |
| | AGA→AAA | R19K | AGA→AAA | R19K | | | |
| | AAA→CAA | K24Q | ACT→TTA | T53L | | | |
| | CAA→AAT | Q38N | GAT→GCA | D54A | | | |
| | ACA→TTA | T53L | GCA→ACC | A55T | | | |
| | GAT→GCA | D54A | GAA→GGA | E56G | | | |
| | GCT→ACC | A55T | GAT→AGG | D57R | | | |
| | GAA→GGA | E56G | CAA→AAA | Q58K | | | |
| | GAT→AGG | D57R | GCT→ATG | A85M | | | |
| | *AAG->AAA* | *K58K* | ATT→TTG | I86L | | | |
| | GTT→ATT | V60I | CAA→GAT | Q87D | | | |
| | GCA→ATG | A85M | CAA→CAC | Q88H | | | |
| | ATA→TTG | I86L | TTG→ATT | L89I | | | |
| | CAA→GAT | Q87D | TGT→TAC | C90Y | | | |
| | AAA→CAC | K88H | ---→AGA | ---→R91 | | | |
| | TTA→ATT | L89I | ---→GCT | ---→A92 | | | |
| | TGT→TAC | C90Y | ---→GAT | ---→D93 | | | |
| | ---→AGA | ---→R91 | *CCA→CCT* | *P91→P94* | | | |
| | ---→GCT | ---→A92 | ATT→TAT | I92→Y95 | | | |
| | ---→GAT | ---→D93 | CAT→TTT | H93→F96 | | | |
| | *CCA->CCT* | *P91→P94* | ATT→GAG | I94→E97 | | | |
| | ATC→TAT | I92→Y95 | GAT→GCT | D95→A98 | | | |
| | TAT→TTT | Y93→F96 | TCT→CAT | S96→H99 | | | |
| | ATT→GAG | I94→E97 | GAT→GAA | D97→E100 | | | |
| | GAC→GCT | D95→A98 | AAA→TAC | K98→Y101 | | | |
| | AGT→CAT | S96→H99 | GCT→AAT | A99→N102 | | | |
| | AAT→GAA | N97→E100 | *TCA→TCT* | *S174→S177* | | | |
| | AGA→TAC | R98→Y101 | TTG→--- | L175→--- | | | |
| | GCT→AAT | A99→N102 | GTT→--- | V176→--- | | | |
| | AAG→CAA | K125→Q128 | CAA→GCT | Q178→A179 | | | |
| | AAG→CAA | K173→Q176 | GAT→CCA | D179→P180 | | | |
| | *TCA->TCT* | *S174->S177* | GTT→TTG | V181→L182 | | | |
| | TTG→--- | L175→--- | ACT→AAG | T182→K183 | | | |
| | GTA→--- | V176→--- | CCA→TCA | P183→S184 | | | |
| | CAG→GCT | Q178→A179 | AGA→CCT | R184→P185 | | | |
| | GAT→CCA | D179→P180 | *CCA→CCC* | *P196→P197* | | | |
| | GTA→TTG | V181→L182 | AGA→TCA | R212→S213 | | | |
| | ACC→AAG | T182→K183 | ATT→ATC | I213→I214 | | | |
| | CCT→TCA | P183→S184 | GAT→TAT | D214→Y215 | | | |
| | AAG→CCT | K184→P185 | TCT→GAC | S215→D216 | | | |
| | *CCT->CCC* | *P196->P197* | ACT→AAG | T216→K217 | | | |
| | TTT→ATT | F209→I210 | TCT→--- | S217→--- | | | |
| | ATG→TCA | M212→S213 | GAT→GAA | D218E | | | |
| | AAT→TAT | N214→Y215 | GAT→CAA | D219Q | | | |
| | TCA→GAC | S215→D216 | TTG→TCG | L220S | | | |
| | ACA→AAG | T216→K217 | GTT→AAG | V221K | | | |
| | AGT→--- | S217→--- | *GGT→GGG* | *G276G* | | | |
| | GAT→GAA | D218E | CCA→TCA | P281S | | | |
| | CAT→CAA | H219Q | TTG→TGC | L313C | | | |
| | TTA→TCG | L220S | TCT→ACG | S314T | | | |
| | TAC→AAG | Y221K | TTG→ATG | L315M | | | |
| | GAG→GAT | E238D | ACC→AGT | T317S | | | |
| | AAA→CAA | K252Q | *GAC→GAT* | *D329D* | | | |
| | CCT→TCA | P281S | AAG→CGA | K336R | | | |
| | CAA→AAA | Q292K | TTA→ATT | L337I | | | |
| | CTC→TGC | L313C | GGT→CGG | G357R | | | |
| | AGC→ACG | S314T | *CAT→CAC* | *H360H* | | | |
| | CTC→ATG | L315M | *AAA→AAG* | *K468K* | | | |
| | ACT→AGT | T317S | GAG→GAT | E484D | | | |
| | CAA→GCT | Q321A | | | | | |
| | GAA→GAT | E333D | | | | | |
| | AAA→CGA | K336R | | | | | |
| | TTG→ATT | L337I | | | | | |

TABLE 43-continued

| CVS Variants | | | | | | | |
|---|---|---|---|---|---|---|---|
| Mutant | Nucleotide changes vs. wildtype | Amino acid changes vs. wildtype | Nucleotide changes vs. CVS V19 | Amino acid changes vs. CVS V19 | SEQ ID NO nt | SEQ ID NO aa | Valencene production % vs. V19 (Shake Flask) |
| | GCT→ACA | A345T | | | | | |
| | GGA→CGG | G357R | | | | | |
| | AAT→ATT | N369I | | | | | |
| | TCT→TAC | S377Y | | | | | |
| | ACA→AGA | T405R | | | | | |
| | AAT→GGT | N429G | | | | | |
| | GCA→TCT | A436S | | | | | |
| | GAA→GAT | E484D | | | | | |
| | ACC→CCA | T501P | | | | | |
| | GAT→GAA | D536E | | | | | |
| V296 | TCG→AAA | S2K | TCA→AAA | S2K | 961 | 960 | 74.2 |
| | TCT→GAA | S3E | TCT→GAA | S3E | | | |
| | GGA→TGT | G4C | GGT→TGT | G4C | | | |
| | GAA→ACG | E5T | GAA→ACG | E5T | | | |
| | ACA→ATG | T6M | ACT→ATG | T6M | | | |
| | TTT→TTA | F7L | TTT→TTA | F7L | | | |
| | AGA→AAA | R19K | AGA→AAA | R19K | | | |
| | AAA→CAA | K24Q | ACT→TTA | T53L | | | |
| | CAA→AAT | Q38N | GAT→GCA | D54A | | | |
| | ACA→TTA | T53L | GCA→ACC | A55T | | | |
| | GAT→GCA | D54A | GAA→GGA | E56G | | | |
| | GCT→ACC | A55T | GAT→AGG | D57R | | | |
| | GAA→GGA | E56G | CAA→AAA | Q58K | | | |
| | GAT→AGG | D57R | GCT→ATG | A85M | | | |
| | *AAG->AAA* | *K58K* | ATT→TTG | I86L | | | |
| | GTT→ATT | V60I | CAA→GAT | Q87D | | | |
| | GCA→ATG | A85M | CAA→CAC | Q88H | | | |
| | ATA→TTG | I86L | TTG→ATT | L89I | | | |
| | CAA→GAT | Q87D | TGT→TAC | C90Y | | | |
| | AAA→CAC | K88H | ---→AGA | ---→R91 | | | |
| | TTA→ATT | L89I | ---→GCT | ---→A92 | | | |
| | TGT→TAC | C90Y | ---→GAT | ---→D93 | | | |
| | ---→AGA | ---→R91 | *CCA→CCT* | *P91→P94* | | | |
| | ---→GCT | ---→A92 | ATT→TAT | I92→Y95 | | | |
| | ---→GAT | ---→D93 | CAT→TTT | H93→F96 | | | |
| | *CCA->CCT* | *P91->P94* | ATT→GAG | I94→E97 | | | |
| | ATC→TAT | I92→Y95 | GAT→GCT | D95→A98 | | | |
| | TAT→TTT | Y93→F96 | TCT→CAT | S96→H99 | | | |
| | ATT→GAG | I94→E97 | GAT→GAA | D97→E100 | | | |
| | GAC→GCT | D95→A98 | AAA→TAC | K98→Y101 | | | |
| | AGT→CAT | S96→H99 | GCT→AAT | A99→N102 | | | |
| | AAT→GAA | N97→E100 | *TCA→TCT* | *S174→S177* | | | |
| | AGA→TAC | R98→Y101 | TTG→--- | L175→--- | | | |
| | GCT→AAT | A99→N102 | GTT→--- | V176→--- | | | |
| | AAG→CAA | K125→Q128 | CAA→GCT | Q178→A179 | | | |
| | AAG→CAA | K173→Q176 | GAT→CCA | D179→P180 | | | |
| | *TCA->TCT* | *S174->S177* | GTT→TTG | V181→L182 | | | |
| | TTG→--- | L175→--- | ACT→AAG | T182→K183 | | | |
| | GTA→--- | V176→--- | CCA→TCA | P183→S184 | | | |
| | CAG→GCT | Q178→A179 | AGA→CCT | R184→P185 | | | |
| | GAT→CCA | D179→P180 | AGA→TCA | R212→S213 | | | |
| | GTA→TTG | V181→L182 | *ATT→ATC* | *I213→I214* | | | |
| | ACC→AAG | T182→K183 | GAT→TAT | D214→Y215 | | | |
| | CCT→TCA | P183→S184 | TCT→GAC | S215→D216 | | | |
| | AAG→CCT | K184→P185 | ACT→AAG | T216→K217 | | | |
| | TTT→ATT | F209→I210 | TCT→--- | S217→--- | | | |
| | ATG→TCA | M212→S213 | GAT→GAA | D218E | | | |
| | AAT→TAT | N214→Y215 | GAT→CAA | D219Q | | | |
| | TCA→GAC | S215→D216 | TTG→TCG | L220S | | | |
| | ACA→AAG | T216→K217 | GTT→AAG | V221K | | | |
| | AGT→--- | S217→--- | GGT→GGG | G276G | | | |
| | GAT→GAA | D218E | CCA→TCA | P281S | | | |
| | CAT→CAA | H219Q | TTG→TGC | L313C | | | |
| | TTA→TCG | L220S | TCT→ACG | S314T | | | |
| | TAC→AAG | Y221K | TTG→ATG | L315M | | | |
| | GAG→GAT | E238D | ACC→AGT | T317S | | | |
| | AAA→CAA | K252Q | *GAC→GAT* | *D329D* | | | |
| | CCT→TCA | P281S | AAG→CGA | K336R | | | |
| | CAA→AAA | Q292K | TTA→ATT | L337I | | | |
| | CTC→TGC | L313C | GGT→CGG | G357R | | | |

TABLE 43-continued

CVS Variants

| Mutant | Nucleotide changes vs. wildtype | Amino acid changes vs. wildtype | Nucleotide changes vs. CVS V19 | Amino acid changes vs. CVS V19 | SEQ ID NO nt | SEQ ID NO aa | Valencene production % vs. V19 (Shake Flask) |
|---|---|---|---|---|---|---|---|
| | AGC→ACG | S314T | *AAA→AAG* | *K468K* | | | |
| | CTC→ATG | L315M | GAG→GAT | E484D | | | |
| | ACT→AGT | T317S | | | | | |
| | CAA→GCT | Q321A | | | | | |
| | GAA→GAT | E333D | | | | | |
| | AAA→CGA | K336R | | | | | |
| | TTG→ATT | L337I | | | | | |
| | GCT→ACA | A345T | | | | | |
| | GGA→CGG | G357R | | | | | |
| | AAT→ATT | N369I | | | | | |
| | TCT→TAC | S377Y | | | | | |
| | ACA→AGA | T405R | | | | | |
| | AAT→GGT | N429G | | | | | |
| | GCA→TCT | A436S | | | | | |
| | GAA→GAT | E484D | | | | | |
| | ACC→CCA | T501P | | | | | |
| | GAT→GAA | D536E | | | | | |
| V297 | AGA→AAA | R19K | AGA→AAA | R19K | 963 | 962 | 61.3 |
| | AAA→CAA | L24Q | ACT→TTA | T53L | | | (avg of |
| | CAA→AAT | Q38N | GAT→GCA | D54A | | | 4 flasks) |
| | ACA→TTA | T53L | GCA→ACC | A55T | | | |
| | GAT→GCA | D54A | GAA→GGA | E56G | | | |
| | GCT→ACC | A55T | GAT→AGG | D57R | | | |
| | GAA→GGA | E56G | CAA→AAA | Q58K | | | |
| | GAT→AGG | D57R | GCT→ATG | A85M | | | |
| | *AAG->AAA* | *K58K* | ATT→TTG | I86L | | | |
| | GTT→ATT | V60I | CAA→GAT | Q87D | | | |
| | GCA→ATG | A85M | CAA→CAC | Q88H | | | |
| | ATA→TTG | I86L | TTG→ATT | L89I | | | |
| | CAA→GAT | Q87D | TGT→TAC | C90Y | | | |
| | AAA→CAC | K88H | ---→AGA | ---→R91 | | | |
| | TTA→ATT | L89I | ---→GCT | ---→A92 | | | |
| | TGT→TAC | C90Y | ---→GAT | ---→D93 | | | |
| | ---→AGA | ---→R91 | *CCA→CCT* | *P91→P94* | | | |
| | ---→GCT | ---→A92 | ATT→TAT | I92→Y95 | | | |
| | ---→GAT | ---→D93 | CAT→TTT | H93→F96 | | | |
| | *CCA->CCT* | *P91->P94* | ATT→GAG | I94→E97 | | | |
| | ATC→TAT | I92→Y95 | GAT→GCT | D95→A98 | | | |
| | TAT→TTT | Y93→F96 | TCT→CAT | S96→H99 | | | |
| | ATT→GAG | I94→E97 | GAT→GAA | D97→E100 | | | |
| | GAC→GCT | D95→A98 | AAA→TAC | K98→Y101 | | | |
| | AGT→CAT | S96→H99 | GCT→AAT | A99→N102 | | | |
| | AAT→GAA | N97→E100 | *GGT→GGG* | *G115→G118* | | | |
| | AGA→TAC | R98→Y101 | ATT→TAC | I116→Y119 | | | |
| | GCT→AAT | A99→N102 | AAG→ACT | K117→T120 | | | |
| | *GGA->GGG* | *G115->G118* | *TCT→TCA* | *S119→S122* | | | |
| | ATC→TAC | I116→Y119 | GTT→ATA | V122→I125 | | | |
| | AAG→ACT | K117→T120 | GAA→AAC | E124→N127 | | | |
| | GTG→ATA | V122→I125 | CAA→AAG | Q125→K128 | | | |
| | GAG→AAC | E124→N127 | AAG→ACG | K127→T130 | | | |
| | AAA→ACG | K127→T130 | GAT→GAA | D129→E132 | | | |
| | GAT→GAA | D129→E132 | GAA→CGA | E130→R133 | | | |
| | GAG→CGA | E130→R133 | *AAA→AAG* | *K134→K137* | | | |
| | TCA→GAA | S135→E138 | AGT→GAA | S135→E138 | | | |
| | TCG→GCT | S136→A139 | TCT→GCT | S136→A139 | | | |
| | *ATA->ATC* | *I138->I141* | *ATT→ATC* | *I138→I141* | | | |
| | AAC→AGC | N139→S142 | AAT→AGC | N139→S142 | | | |
| | *GTT->GTA* | *V141->V144* | *GTT→GTA* | *V141→V144* | | | |
| | CAA→AGA | Q142→R145 | CAA→AGA | Q142→R145 | | | |
| | *TTA->CTA* | *L145->L148* | *TTG→CTA* | *L145→L148* | | | |
| | AGT→GGC | S146→G149 | TCT→GGC | S146→G149 | | | |
| | AAG→CAA | K173→Q176 | *TCA→TCT* | *S174→S177* | | | |
| | *TCA->TCT* | *S174->S177* | TTG→--- | L175→--- | | | |
| | TTG→--- | L175→--- | GTT→--- | V176→--- | | | |
| | GTA→--- | V176→--- | CAA→GCT | Q178→A179 | | | |
| | GAG→GCT | Q178→A179 | GAT→CCA | D179→P180 | | | |
| | GAT→CCA | D179→P180 | GTT→TTG | V181→L182 | | | |
| | GTA→TTG | V181→L182 | ACT→AAG | T182→K183 | | | |
| | ACC→AAG | T182→K183 | CCA→TCA | P183→S184 | | | |
| | CCT→TCA | P183→S184 | AGA→CCT | R184→P185 | | | |

TABLE 43-continued

| CVS Variants | | | | | | | |
|---|---|---|---|---|---|---|---|
| Mutant | Nucleotide changes vs. wildtype | Amino acid changes vs. wildtype | Nucleotide changes vs. CVS V19 | Amino acid changes vs. CVS V19 | SEQ ID NO nt | SEQ ID NO aa | Valencene production % vs. V19 (Shake Flask) |
| | AAG→CCT | K184→P185 | *GGT→GGG* | *G276→G277* | | | |
| | TTT→ATT | F209→I210 | CCA→TCA | P281→S282 | | | |
| | ATG→AGA | M212→R213 | TTG→TGC | L313→C314 | | | |
| | AAT→GAT | N214→D215 | TCT→ACG | S314→T315 | | | |
| | CAT→GAT | H219→D220 | TTG→ATG | L315→M316 | | | |
| | TAC→GTT | Y221→V222 | ACC→AGT | T317→S318 | | | |
| | GAG→GAT | E238→D239 | *GAC→GAT* | *D329→D330* | | | |
| | AAA→CAA | K252→Q253 | AAG→CGA | K336→R337 | | | |
| | CCT→TCA | P281→S282 | TTA→ATT | L337→I338 | | | |
| | CAA→AAA | Q292→K293 | GGT→CGG | G357→R358 | | | |
| | CTC→TGC | L313→C314 | GAG→GAT | E484→D485 | | | |
| | AGC→ACG | S314→T315 | | | | | |
| | CTC→ATG | L315→M316 | | | | | |
| | ACT→AGT | T317→S318 | | | | | |
| | CAA→GCT | Q321→A322 | | | | | |
| | GAA→GAT | E333→D334 | | | | | |
| | AAA→CGA | K336→R337 | | | | | |
| | TTG→ATT | L337→I338 | | | | | |
| | GCT→ACA | A345→T346 | | | | | |
| | GGA→CGG | G357→R358 | | | | | |
| | AAT→ATT | N369→I370 | | | | | |
| | TCT→TAC | S377→Y378 | | | | | |
| | ACA→AGA | T405→R406 | | | | | |
| | AAT→GGT | N429→G430 | | | | | |
| | GCA→TCT | A436→S437 | | | | | |
| | GAA→GAT | E484→D485 | | | | | |
| | ACC→CCA | T501→P502 | | | | | |
| | GAT→GAA | D536→E537 | | | | | |
| V298 | TCG→AAA | S2K | TCA→AAA | S2K | 965 | 964 | 83 |
| | TCT→GAA | S3E | TCT→GAA | S3E | | | |
| | GGA→TGT | G4C | GGT→TGT | G4C | | | |
| | GAA→ACG | E5T | GAA→ACG | E5T | | | |
| | ACA→ATG | T6M | ACT→ATG | T6M | | | |
| | TTT→TTA | F7L | TTT→TTA | F7L | | | |
| | AGA→AAA | R19K | AGA→AAA | R19K | | | |
| | AAA→CAA | K24Q | ACT→TTA | T53L | | | |
| | CAA→AAT | Q38N | GAT→GCA | D54A | | | |
| | ACA→TTA | T53L | GCA→ACC | A55T | | | |
| | GAT→GCA | D54A | GAA→GGA | E56G | | | |
| | GCT→ACC | A55T | GAT→AGG | D57R | | | |
| | GAA→GGA | E56G | CAA→AAA | Q58K | | | |
| | GAT→AGG | D57R | GCT→ATG | A85M | | | |
| | *AAG->AAA* | *K58K* | ATT→TTG | I86L | | | |
| | GTT→ATT | V60I | CAA→GAT | Q87D | | | |
| | GCA→ATG | A85M | CAA→CAC | Q88H | | | |
| | ATA→TTG | I86L | TTG→ATT | L89I | | | |
| | CAA→GAT | Q87D | TGT→TAC | C90Y | | | |
| | AAA→CAC | K88H | ---→AGA | ---→R91 | | | |
| | TTA→ATT | L89I | ---→GCT | ---→A92 | | | |
| | TGT→TAC | C90Y | ---→GAT | ---→D93 | | | |
| | ---→AGA | ---→R91 | *CCA→CCT* | *P91→P94* | | | |
| | ---→GCT | ---→A92 | ATT→TAT | I92→Y95 | | | |
| | ---→GAT | ---→D93 | CAT→TTT | H93→F96 | | | |
| | *CCA->CCT* | *P91->P94* | ATT→GAG | I94→E97 | | | |
| | ATC→TAT | I92→Y95 | GAT→GCT | D95→A98 | | | |
| | TAT→TTT | Y93→F96 | TCT→CAT | S96→H99 | | | |
| | ATT→GAG | I94→E97 | GAT→GAA | D97→E100 | | | |
| | GAC→GCT | D95→A98 | AAA→TAC | K98→Y101 | | | |
| | AGT→CAT | S96→H99 | GCT→AAT | A99→N102 | | | |
| | AAT→GAA | N97→E100 | *TCA→TCT* | *S174→S177* | | | |
| | AGA→TAC | R98→Y101 | TTG→--- | L175→--- | | | |
| | GCT→AAT | A99→N102 | GTT→--- | V176→--- | | | |
| | AAG→CAA | K125→Q128 | CAA→GCT | Q178→A179 | | | |
| | AAG→CAA | K173→Q176 | GAT→CCA | D179→P180 | | | |
| | *TCA→TCT* | *S174->S177* | GTT→TTG | V181→L182 | | | |
| | TTG→--- | L175→--- | ACT→AAG | T182→K183 | | | |
| | GTA→--- | V176→--- | CCA→TCA | P183→S184 | | | |
| | CAG→GCT | Q178→A179 | AGA→CCT | R184→P185 | | | |
| | GAT→CCA | D179→P180 | *ACT→ACC* | *T200→T201* | | | |
| | GTA→TTG | V181→L182 | AGA→TCA | R212→S213 | | | |

TABLE 43-continued

| CVS Variants | | | | | | | |
|---|---|---|---|---|---|---|---|
| Mutant | Nucleotide changes vs. wildtype | Amino acid changes vs. wildtype | Nucleotide changes vs. CVS V19 | Amino acid changes vs. CVS V19 | SEQ ID NO nt | SEQ ID NO aa | Valencene production % vs. V19 (Shake Flask) |
| | ACC→AAG | T182→K183 | *ATT→ATC* | *I213→I214* | | | |
| | CCT→TCA | P183→S184 | GAT→TAT | D214→Y215 | | | |
| | AAG→CCT | K184→P185 | TCT→GAC | S215→D216 | | | |
| | TTT→ATT | F209→I210 | ACT→AAG | T216→K217 | | | |
| | ATG→TCA | M212→S213 | TCT→--- | S217→--- | | | |
| | AAT→TAT | N214→Y215 | GAT→GAA | D218E | | | |
| | TCA→GAC | S215→D216 | GAT→CAA | D219Q | | | |
| | ACA→AAG | T216→K217 | TTG→TCG | L220S | | | |
| | AGT→--- | S217→--- | GTT→AAG | V221K | | | |
| | GAT→GAA | D218E | *GGT→GGG* | *G276G* | | | |
| | CAT→CAA | H219Q | CCA→TCA | P281S | | | |
| | TTA→TCG | L220S | TTG→TGC | L313C | | | |
| | TAC→AAG | Y221K | TCT→ACG | S314T | | | |
| | GAG→GAT | E238D | TTG→ATG | L315M | | | |
| | AAA→CAA | K252Q | ACC→AGT | T317S | | | |
| | CCT→TCA | P281S | *GAC→GAT* | *D329D* | | | |
| | CAA→AAA | Q292K | AAG→CGA | K336R | | | |
| | CTC→TGC | L313C | TTA→ATT | L337I | | | |
| | AGC→ACG | S314T | GGT→CGG | G357R | | | |
| | CTC→ATG | L315M | GGT→GGC | G457G | | | |
| | ACT→AGT | T317S | *AAA→AAG* | *K468K* | | | |
| | CAA→GCT | Q321A | GAG→GAT | E484D | | | |
| | GAA→GAT | E333D | | | | | |
| | AAA→CGA | K336R | | | | | |
| | TTG→ATT | L337I | | | | | |
| | GCT→ACA | A345T | | | | | |
| | GGA→CGG | G357R | | | | | |
| | AAT→ATT | N369I | | | | | |
| | TCT→TAC | S377Y | | | | | |
| | ACA→AGA | T405R | | | | | |
| | AAT→GGT | N429G | | | | | |
| | GCA→TCT | A436S | | | | | |
| | *GGA→GGC* | *G457G* | | | | | |
| | GAA→GAT | E484D | | | | | |
| | ACC→CCA | T501P | | | | | |
| | GAT→GAA | D536E | | | | | |
| V299 | *TCG→TCC* | *S2S* | *TCA→TCC* | *S2S* | 967 | 966 | |
| | GCA→ACT | A11T | GCT→ACT | A11T | | | |
| | AGA→AAA | R19K | AGA→AAA | R19K | | | |
| | AAA→CAA | K24Q | ACT→TTA | T53L | | | |
| | CAA→AAT | Q38N | GAT→GCA | D54A | | | |
| | ACA→TTA | T53L | GCA→ACC | A55T | | | |
| | GAT→GCA | D54A | GAA→GGA | E56G | | | |
| | GCT→ACC | A55T | GAT→AGG | D57R | | | |
| | GAA→GGA | E56G | CAA→AAA | Q58K | | | |
| | GAT→AGG | D57R | *GTT→GTA* | *V74V* | | | |
| | *AAG->AAA* | *K58K* | GCT→ATG | A85M | | | |
| | GTT→ATT | V60I | ATT→TTG | I86L | | | |
| | *GTG→GTA* | *V74V* | CAA→GAT | Q87D | | | |
| | GCA→ATG | A85M | CAA→CAC | Q88H | | | |
| | ATA→TTG | I86L | TTG→ATT | L89I | | | |
| | CAA→GAT | Q87D | TGT→TAC | C90Y | | | |
| | AAA→CAC | K88H | ---→AGA | ---→R91 | | | |
| | TTA→ATT | L89I | ---→GCT | ---→A92 | | | |
| | TGT→TAC | C90Y | ---→GAT | ---→D93 | | | |
| | ---→AGA | ---→R91 | *CCA→CCT* | *P91→P94* | | | |
| | ---→GCT | ---→A92 | ATT→TAT | I92→Y95 | | | |
| | ---→GAT | ---→D93 | CAT→TTT | H93→F96 | | | |
| | *CCA->CCT* | *P91->P94* | ATT→GAG | I94→E97 | | | |
| | ATC→TAT | I92→Y95 | GAT→GCT | D95→A98 | | | |
| | TAT→TTT | Y93→F96 | TCT→CAT | S96→H99 | | | |
| | ATT→GAG | I94→E97 | GAT→GAA | D97→E100 | | | |
| | GAC→GCT | D95→A98 | AAA→TAC | K98→Y101 | | | |
| | AGT→CAT | S96→H99 | GCT→AAT | A99→N102 | | | |
| | AAT→GAA | N97→E100 | *TCA→TCT* | *S174→S177* | | | |
| | AGA→TAC | R98→Y101 | TTG→--- | L175→--- | | | |
| | GCT→AAT | A99→N102 | GTT→--- | V176→--- | | | |
| | AAG→CAA | K125→Q128 | CAA→GCT | Q178→A179 | | | |
| | AAG→CAA | K173→Q176 | GAT→CCA | D179→P180 | | | |
| | *TCA->TCT* | *S174->S177* | GTT→TTG | V181→L182 | | | |
| | TTG→--- | L175→--- | ACT→AAG | T182→K183 | | | |

TABLE 43-continued

| Mutant | Nucleotide changes vs. wildtype | Amino acid changes vs. wildtype | Nucleotide changes vs. CVS V19 | Amino acid changes vs. CVS V19 | SEQ ID NO nt | SEQ ID NO aa | Valencene production % vs. V19 (Shake Flask) |
|---|---|---|---|---|---|---|---|
| | CVS Variants | | | | | | |
| | GTA→--- | V176→--- | CCA→TCA | P183→S184 | | | |
| | CAG→GCT | Q178→A179 | AGA→CCT | R184→P185 | | | |
| | GAT→CCA | D179→P180 | *GGT→GGG* | *G276→G277* | | | |
| | GTA→TTG | V181→L182 | CCA→TCA | P281→S282 | | | |
| | ACC→AAG | T182→K183 | TTG→TGC | L313→C314 | | | |
| | CCT→TCA | P183→S184 | TCT→ACG | S314→T315 | | | |
| | AAG→CCT | K184→P185 | TTG→ATG | L315→M316 | | | |
| | TTT→ATT | F209→I210 | ACC→AGT | T317→S318 | | | |
| | ATG→AGA | M212→R213 | *GAC→GAT* | *D329→D330* | | | |
| | AAT→GAT | N214→D215 | AAG→CGA | K336→R337 | | | |
| | CAT→GAT | H219→D220 | TTA→ATT | L337→I338 | | | |
| | TAC→GTT | Y221→V222 | GGT→CGG | G357→R358 | | | |
| | GAG→GAT | E238→D239 | GAG→GAT | E484→D485 | | | |
| | AAA→CAA | K252→Q253 | | | | | |
| | CCT→TCA | P281→S282 | | | | | |
| | CAA→AAA | Q292→K293 | | | | | |
| | CTC→TGC | L313→C314 | | | | | |
| | AGC→ACG | S314→T315 | | | | | |
| | CTC→ATG | L315→M316 | | | | | |
| | ACT→AGT | T317→S318 | | | | | |
| | CAA→GCT | Q321→A322 | | | | | |
| | GAA→GAT | E333→D334 | | | | | |
| | AAA→CGA | K336→R337 | | | | | |
| | TTG→ATT | L337→I338 | | | | | |
| | GCT→ACA | A345→T346 | | | | | |
| | GGA→CGG | G357→R358 | | | | | |
| | AAT→ATT | N369→I370 | | | | | |
| | TCT→TAC | S377→Y378 | | | | | |
| | ACA→AGA | T405→R406 | | | | | |
| | AAT→GGT | N429→G430 | | | | | |
| | GCA→TCT | A436→S437 | | | | | |
| | GAA→GAT | E484→D485 | | | | | |
| | ACC→CCA | T501→P502 | | | | | |
| | GAT→GAA | D536→E537 | | | | | |
| V300 | ATG→ACG | M1T | ATG→ACG | M1T | 969 | 968 | |
| | AGA→AAA | R19K | AGA→AAA | R19K | | | |
| | AAA→CAA | K24Q | ACT→TTA | T53L | | | |
| | CAA→AAT | Q38N | GAT→GCA | D54A | | | |
| | ACA→TTA | T53L | GCA→ACC | A55T | | | |
| | GAT→GCA | D54A | GAA→GGA | E56G | | | |
| | GCT→ACC | A55T | GAT→AGG | D57R | | | |
| | GAA→GGA | E56G | CAA→AAA | Q58K | | | |
| | GAT→AGG | D57R | GCT→ATG | A85M | | | |
| | *AAG->AAA* | *K58K* | ATT→TTG | I86L | | | |
| | GTT→ATT | V60I | CAA→GAT | Q87D | | | |
| | GCA→ATG | A85M | CAA→CAC | Q88H | | | |
| | ATA→TTG | I86L | TTG→ATT | L89I | | | |
| | CAA→GAT | Q87D | TGT→TAC | C90Y | | | |
| | AAA→CAC | K88H | ---→AGA | ---→R91 | | | |
| | TTA→ATT | L89I | ---→GCT | ---→A92 | | | |
| | TGT→TAC | C90Y | ---→GAT | ---→D93 | | | |
| | ---→AGA | ---→R91 | *CCA→CCT* | *P91→P94* | | | |
| | ---→GCT | ---→A92 | ATT→TAT | I92→Y95 | | | |
| | ---→GAT | ---→D93 | CAT→TTT | H93→F96 | | | |
| | *CCA->CCT* | *P91->P94* | ATT→GAG | I94→E97 | | | |
| | ATC→TAT | I92→Y95 | GAT→GCT | D95→A98 | | | |
| | TAT→TTT | Y93→F96 | TCT→CAT | S96→H99 | | | |
| | ATT→GAG | I94→E97 | GAT→GAA | D97→E100 | | | |
| | GAC→GCT | D95→A98 | AAA→TAC | K98→Y101 | | | |
| | AGT→CAT | S96→H99 | GCT→AAT | A99→N102 | | | |
| | AAT→GAA | N97→E100 | TAT→CAT | Y152→H155 | | | |
| | AGA→TAC | R98→Y101 | *TCA→TCT* | *S174→S177* | | | |
| | GCT→AAT | A99→N102 | TTG→--- | L175→--- | | | |
| | AAG→CAA | K125→Q128 | GTT→--- | V176→--- | | | |
| | TAC→CAT | Y152→H155 | CAA→GCT | Q178→A179 | | | |
| | AAG→CAA | K173→Q176 | GAT→CCA | D179→P180 | | | |
| | *TCA->TCT* | *S174->S177* | GTT→TTG | V181→L182 | | | |
| | TTG→--- | L175→--- | ACT→AAG | T182→K183 | | | |
| | GTA→--- | V176→--- | CCA→TCA | P183→S184 | | | |
| | CAG→GCT | Q178→A179 | AGA→CCT | R184→P185 | | | |

TABLE 43-continued

| CVS Variants | | | | | | |
|---|---|---|---|---|---|---|
| Mutant | Nucleotide changes vs. wildtype | Amino acid changes vs. wildtype | Nucleotide changes vs. CVS V19 | Amino acid changes vs. CVS V19 | SEQ ID NO nt aa | Valencene production % vs. V19 (Shake Flask) |
| | GAT→CCA | D179→P180 | *GGT→GGG* | *G276→G277* | | |
| | GTA→TTG | V181→L182 | CCA→TCA | P281→S282 | | |
| | ACC→AAG | T182→K183 | TTG→TGC | L313→C314 | | |
| | CCT→TCA | P183→S184 | TCT→ACG | S314→T315 | | |
| | AAG→CCT | K184→P185 | TTG→ATG | L315→M316 | | |
| | TTT→ATT | F209→I210 | ACC→AGT | T317→S318 | | |
| | ATG→AGA | M212→R213 | *GAC→GAT* | *D329→D330* | | |
| | AAT→GAT | N214→D215 | AAG→CGA | K336→R337 | | |
| | CAT→GAT | H219→D220 | TTA→ATT | L337→I338 | | |
| | TAC→GTT | Y221→V222 | GGT→CGG | G357→R358 | | |
| | GAG→GAT | E238→D239 | TGT→CGT | C361→R362 | | |
| | AAA→CAA | K252→Q253 | AAA→CAA | K468→Q469 | | |
| | CCT→TCA | P281→S282 | GAG→GAT | E484→D485 | | |
| | CAA→AAA | Q292→K293 | | | | |
| | CTC→TGC | L313→C314 | | | | |
| | AGC→ACG | S314→T315 | | | | |
| | CTC→ATG | L315→M316 | | | | |
| | ACT→AGT | T317→S318 | | | | |
| | CAA→GCT | Q321→A322 | | | | |
| | GAA→GAT | E333→D334 | | | | |
| | AAA→CGA | K336→R337 | | | | |
| | TTG→ATT | L337→I338 | | | | |
| | GCT→ACA | A345→T346 | | | | |
| | GGA→CGG | G357→R358 | | | | |
| | TGC→CGT | C361→R362 | | | | |
| | AAT→ATT | N369→I370 | | | | |
| | TCT→TAC | S377→Y378 | | | | |
| | ACA→AGA | T405→R406 | | | | |
| | AAT→GGT | N429→G430 | | | | |
| | GCA→TCT | A436→S437 | | | | |
| | AAG→CAA | K468→Q469 | | | | |
| | GAA→GAT | E484→D485 | | | | |
| | ACC→CCA | T501→P502 | | | | |
| | GAT→GAA | D536→E537 | | | | |
| V301 | TCG→TGC | S2C | TCA→TGC | S2C | 971 970 | 80.22 |
| | TCT→ATG | S3M | TCT→ATG | S3M | | |
| | GGA→ACA | G4T | GGT→ACA | G4T | | |
| | GAA→GGT | E5G | GAA→GGT | E5G | | |
| | ACA→GAA | T6E | ACT→GAA | T6E | | |
| | TTT→TCG | F7S | TTT→TCG | F7S | | |
| | AGA→AAA | R19K | AGA→AAA | R19K | | |
| | AAA→CAA | K24Q | ACT→TTA | T53L | | |
| | CAA→AAT | Q38N | GAT→GCA | D54A | | |
| | ACA→TTA | T53L | GCA→ACC | A55T | | |
| | GAT→GCA | D54A | GAA→GGA | E56G | | |
| | GCT→ACC | A55T | GAT→AGG | D57R | | |
| | GAA→GGA | E56G | CAA→AAA | Q58K | | |
| | GAT→AGG | D57R | GCT→ATG | A85M | | |
| | *AAG->AAA* | *K58K* | ATT→TTG | I86L | | |
| | GTT→ATT | V60I | CAA→GAT | Q87D | | |
| | GCA→ATG | A85M | CAA→CAC | Q88H | | |
| | ATA→TTG | I86L | TTG→ATT | L89I | | |
| | CAA→GAT | Q87D | TGT→TAC | C90Y | | |
| | AAA→CAC | K88H | ---→AGA | ---→R91 | | |
| | TTA→ATT | L89I | ---→GCT | ---→A92 | | |
| | TGT→TAC | C90Y | ---→GAT | ---→D93 | | |
| | ---→AGA | ---→R91 | *CCA→CCT* | *P91→P94* | | |
| | ---→GCT | ---→A92 | ATT→TAT | I92→Y95 | | |
| | ---→GAT | ---→D93 | CAT→TTT | H93→F96 | | |
| | *CCA->CCT* | *P91->P94* | ATT→GAG | I94→E97 | | |
| | ATC→TAT | I92→Y95 | GAT→GCT | D95→A98 | | |
| | TAT→TTT | Y93→F96 | TCT→CAT | S96→H99 | | |
| | ATT→GAG | I94→E97 | GAT→GAA | D97→E100 | | |
| | GAC→GCT | D95→A98 | AAA→TAC | K98→Y101 | | |
| | AGT→CAT | S96→H99 | GCT→AAT | A99→N102 | | |
| | AAT→GAA | N97→E100 | *TCA→TCT* | *S174→S177* | | |
| | AGA→TAC | R98→Y101 | TTG→--- | L175→--- | | |
| | GCT→AAT | A99→N102 | GTT→--- | V176→--- | | |
| | AAG→CAA | K125→Q128 | CAA→GCT | Q178→A179 | | |
| | AAG→CAA | K173→Q176 | GAT→CCA | D179→P180 | | |

TABLE 43-continued

CVS Variants

| Mutant | Nucleotide changes vs. wildtype | Amino acid changes vs. wildtype | Nucleotide changes vs. CVS V19 | Amino acid changes vs. CVS V19 | SEQ ID NO nt | SEQ ID NO aa | Valencene production % vs. V19 (Shake Flask) |
|---|---|---|---|---|---|---|---|
| | *TCA->TCT* | *S174->S177* | GTT→TTG | V181→L182 | | | |
| | TTG→--- | L175→--- | ACT→AAG | T182→K183 | | | |
| | GTA→--- | V176→--- | CCA→TCA | P183→S184 | | | |
| | CAG→GCT | Q178→A179 | AGA→CCT | R184→P185 | | | |
| | GAT→CCA | D179→P180 | *CCA→CCG* | *P196→P197* | | | |
| | GTA→TTG | V181→L182 | AGA→TCA | R212→S213 | | | |
| | ACC→AAG | T182→K183 | *ATT→ATC* | *I213→I214* | | | |
| | CCT→TCA | P183→S184 | GAT→TAT | D214→Y215 | | | |
| | AAG→CCT | K184→P185 | TCT→GAC | S215→D216 | | | |
| | *CCT->CCG* | *P196->P197* | ACT→AAG | T216→K217 | | | |
| | TTT→ATT | F209→I210 | TCT→--- | S217→--- | | | |
| | ATG→TCA | M212→S213 | GAT→GAA | D218E | | | |
| | AAT→TAT | N214→Y215 | GAT→CAA | D219Q | | | |
| | TCA→GAC | S215→D216 | TTG→TCG | L220S | | | |
| | ACA→AAG | T216→K217 | GTT→AAG | V221K | | | |
| | AGT→--- | S217→--- | *GGT→GGG* | *G276G* | | | |
| | GAT→GAA | D218E | CCA→TCA | P281S | | | |
| | CAT→CAA | H219Q | TTG→TGC | L313C | | | |
| | TTA→TCG | L220S | TCT→ACG | S314T | | | |
| | TAC→AAG | Y221K | TTG→ATG | L315M | | | |
| | GAG→GAT | E238D | ACC→AGT | T317S | | | |
| | AAA→CAA | K252Q | *GAC→GAT* | *D329D* | | | |
| | CCT→TCA | P281S | AAG→CGA | K336R | | | |
| | CAA→AAA | Q292K | TTA→ATT | L337I | | | |
| | CTC→TGC | L313C | GGT→CGG | G357R | | | |
| | AGC→ACG | S314T | GAG→GAT | E484D | | | |
| | CTC→ATG | L315M | | | | | |
| | ACT→AGT | T317S | | | | | |
| | CAA→GCT | Q321A | | | | | |
| | GAA→GAT | E333D | | | | | |
| | AAA→CGA | K336R | | | | | |
| | TTG→ATT | L337I | | | | | |
| | GCT→ACA | A345T | | | | | |
| | GGA→CGG | G357R | | | | | |
| | AAT→ATT | N369I | | | | | |
| | TCT→TAC | S377Y | | | | | |
| | ACA→AGA | T405R | | | | | |
| | AAT→GGT | N429G | | | | | |
| | GCA→TCT | A436S | | | | | |
| | GAA→GAT | E484D | | | | | |
| | ACC→CCA | T501P | | | | | |
| | GAT→GAA | D536E | | | | | |
| V302 | TCG→TGC | S2C | TCA→TGC | S2C | 973 | 972 | 90.8 |
| | TCT→ATG | S3M | TCT→ATG | S3M | | | |
| | GGA→ACA | G4T | GGT→ACA | G4T | | | |
| | GAA→GGT | E5G | GAA→GGT | E5G | | | |
| | ACA→GAA | T6E | ACT→GAA | T6E | | | |
| | TTT→TCG | F7S | TTT→TCG | F7S | | | |
| | AGA→AAA | R19K | AGA→AAA | R19K | | | |
| | AAA→CAA | K24Q | ACT→TTA | T53L | | | |
| | CAA→AAT | Q38N | GAT→GCA | D54A | | | |
| | ACA→TTA | T53L | GCA→ACC | A55T | | | |
| | GAT→GCA | D54A | GAA→GGA | E56G | | | |
| | GCT→ACC | A55T | GAT→AGG | D57R | | | |
| | GAA→GGA | E56G | CAA→AAA | Q58K | | | |
| | GAT→AGG | D57R | GCT→ATG | A85M | | | |
| | *AAG->AAA* | *K58K* | ATT→TTG | I86L | | | |
| | GTT→ATT | V60I | CAA→GAT | Q87D | | | |
| | GCA→ATG | A85M | CAA→CAC | Q88H | | | |
| | ATA→TTG | I86L | TTG→ATT | L89I | | | |
| | CAA→GAT | Q87D | TGT→TAC | C90Y | | | |
| | AAA→CAC | K88H | ---→AGA | ---→R91 | | | |
| | TTA→ATT | L89I | ---→GCT | ---→A92 | | | |
| | TGT→TAC | C90Y | ---→GAT | ---→D93 | | | |
| | ---→AGA | ---→R91 | *CCA→CCT* | *P91→P94* | | | |
| | ---→GCT | ---→A92 | ATT→TAT | I92→Y95 | | | |
| | ---→GAT | ---→D93 | CAT→TTT | H93→F96 | | | |
| | *CCA->CCT* | *P91->P94* | ATT→GAG | I94→E97 | | | |
| | ATC→TAT | I92→Y95 | GAT→GCT | D95→A98 | | | |
| | TAT→TTT | Y93→F96 | TCT→CAT | S96→H99 | | | |

TABLE 43-continued

| CVS Variants | | | | | | | |
|---|---|---|---|---|---|---|---|
| Mutant | Nucleotide changes vs. wildtype | Amino acid changes vs. wildtype | Nucleotide changes vs. CVS V19 | Amino acid changes vs. CVS V19 | SEQ ID NO nt | SEQ ID NO aa | Valencene production % vs. V19 (Shake Flask) |
| | ATT→GAG | I94→E97 | GAT→GAA | D97→E100 | | | |
| | GAC→GCT | D95→A98 | AAA→TAC | K98→Y101 | | | |
| | AGT→CAT | S96→H99 | GCT→AAT | A99→N102 | | | |
| | AAT→GAA | N97→E100 | *TCA→TCT* | *S174→S177* | | | |
| | AGA→TAC | R98→Y101 | TTG→--- | L175→--- | | | |
| | GCT→AAT | A99→N102 | GTT→--- | V176→--- | | | |
| | AAG→CAA | K125→Q128 | CAA→GCT | Q178→A179 | | | |
| | AAG→CAA | K173→Q176 | GAT→CCA | D179→P180 | | | |
| | *TCA->TCT* | *S174->S177* | GTT→TTG | V181→L182 | | | |
| | TTG→--- | L175→--- | ACT→AAG | T182→K183 | | | |
| | GTA→--- | V176→--- | CCA→TCA | P183→S184 | | | |
| | CAG→GCT | Q178→A179 | AGA→CCT | R184→P185 | | | |
| | GAT→CCA | D179→P180 | *AGA→CGG* | *R198→R199* | | | |
| | GTA→TTG | V181→L182 | AGA→TCA | R212→S213 | | | |
| | ACC→AAG | T182→K183 | *ATT→ATC* | *I213→I214* | | | |
| | CCT→TCA | P183→S184 | GAT→TAT | D214→Y215 | | | |
| | AAG→CCT | K184→P185 | TCT→GAC | S215→D216 | | | |
| | *CGT->CGG* | *R198->R199* | ACT→AAG | T216→K217 | | | |
| | TTT→ATT | F209→I210 | TCT→--- | S217→--- | | | |
| | ATG→TCA | M212→S213 | GAT→GAA | D218E | | | |
| | AAT→TAT | N214→Y215 | GAT→CAA | D219Q | | | |
| | TCA→GAC | S215→D216 | TTG→TCG | L220S | | | |
| | ACA→AAG | T216→K217 | GTT→AAG | V221K | | | |
| | AGT→--- | S217→--- | *GGT→GGG* | *G276G* | | | |
| | GAT→GAA | D218E | CCA→TCA | P281S | | | |
| | CAT→CAA | H219Q | TTG→TGC | L313C | | | |
| | TTA→TCG | L220S | TCT→ACG | S314T | | | |
| | TAC→AAG | Y221K | TTG→ATG | L315M | | | |
| | GAG→GAT | E238D | ACC→AGT | T317S | | | |
| | AAA→CAA | K252Q | *GAC→GAT* | *D329D* | | | |
| | CCT→TCA | P281S | AAG→CGA | K336R | | | |
| | CAA→AAA | Q292K | TTA→ATT | L337I | | | |
| | CTC→TGC | L313C | GGT→CGG | G357R | | | |
| | AGC→ACG | S314T | GAG→GAT | E484D | | | |
| | CTC→ATG | L315M | | | | | |
| | ACT→AGT | T317S | | | | | |
| | CAA→GCT | Q321A | | | | | |
| | GAA→GAT | E333D | | | | | |
| | AAA→CGA | K336R | | | | | |
| | TTG→ATT | L337I | | | | | |
| | GCT→ACA | A345T | | | | | |
| | GGA→CGG | G357R | | | | | |
| | AAT→ATT | N369I | | | | | |
| | TCT→TAC | S377Y | | | | | |
| | ACA→AGA | T405R | | | | | |
| | AAT→GGT | N429G | | | | | |
| | GCA→TCT | A436S | | | | | |
| | GAA→GAT | E484D | | | | | |
| | ACC→CCA | T501P | | | | | |
| | GAT→GAA | D536E | | | | | |
| V303 | TCG→AAA | S2K | TCA→AAA | S2K | 975 | 974 | 81 |
| | TCT→GAA | S3E | TCT→GAA | S3E | | | |
| | GGA→TGT | G4C | GGT→TGT | G4C | | | |
| | GAA→ACG | E5T | GAA→ACG | E5T | | | |
| | ACA→ATG | T6M | ACT→ATG | T6M | | | |
| | TTT→TTA | F7L | TTT→TTA | F7L | | | |
| | AGA→AAA | R19K | AGA→AAA | R19K | | | |
| | AAA→CAA | K24Q | ACT→TTA | T53L | | | |
| | CAA→AAT | Q38N | GAT→GCA | D54A | | | |
| | ACA→TTA | T53L | GCA→ACC | A55T | | | |
| | GAT→GCA | D54A | GAA→GGA | E56G | | | |
| | GCT→ACC | A55T | GAT→AGG | D57R | | | |
| | GAA→GGA | E56G | CAA→AAA | Q58K | | | |
| | GAT→AGG | D57R | GCT→ATG | A85M | | | |
| | *AAG->AAA* | *K58K* | ATT→TTG | I86L | | | |
| | GTT→ATT | V60I | CAA→GAT | Q87D | | | |
| | GCA→ATG | A85M | CAA→CAC | Q88H | | | |
| | ATA→TTG | I86L | TTG→ATT | L89I | | | |
| | CAA→GAT | Q87D | TGT→TAC | C90Y | | | |
| | AAA→CAC | K88H | ---→AGA | ---→R91 | | | |

TABLE 43-continued

| CVS Variants | | | | | | | |
|---|---|---|---|---|---|---|---|
| Mutant | Nucleotide changes vs. wildtype | Amino acid changes vs. wildtype | Nucleotide changes vs. CVS V19 | Amino acid changes vs. CVS V19 | SEQ ID NO nt | SEQ ID NO aa | Valencene production % vs. V19 (Shake Flask) |
| | TTA→ATT | L89I | ---→GCT | ---→A92 | | | |
| | TGT→TAC | C90Y | ---→GAT | ---→D93 | | | |
| | ---→AGA | ---→R91 | *CCA→CCT* | *P91→P94* | | | |
| | ---→GCT | ---→A92 | ATT→TAT | I92→Y95 | | | |
| | ---→GAT | ---→D93 | CAT→TTT | H93→F96 | | | |
| | *CCA->CCT* | *P91->P94* | ATT→GAG | I94→E97 | | | |
| | ATC→TAT | I92→Y95 | GAT→GCT | D95→A98 | | | |
| | TAT→TTT | Y93→F96 | TCT→CAT | S96→H99 | | | |
| | ATT→GAG | I94→E97 | GAT→GAA | D97→E100 | | | |
| | GAC→GCT | D95→A98 | AAA→TAC | K98→Y101 | | | |
| | AGT→CAT | S96→H99 | GCT→AAT | A99→N102 | | | |
| | AAT→GAA | N97→E100 | *TCA→TCT* | *S174→S177* | | | |
| | AGA→TAC | R98→Y101 | TTG→--- | L175→--- | | | |
| | GCT→AAT | A99→N102 | GTT→--- | V176→--- | | | |
| | AAG→CAA | K125→Q128 | CAA→GCT | Q178→A179 | | | |
| | AAG→CAA | K173→Q176 | GAT→CCA | D179→P180 | | | |
| | *TCA->TCT* | *S174->S177* | GTT→TTG | V181→L182 | | | |
| | TTG→--- | L175→--- | ACT→AAG | T182→K183 | | | |
| | GTA→--- | V176→--- | CCA→TCA | P183→S184 | | | |
| | CAG→GCT | Q178→A179 | AGA→CCT | R184→P185 | | | |
| | GAT→CCA | D179→P180 | ACT→CAA | T200→Q201 | | | |
| | GTA→TTG | V181→L182 | AGA→TCA | R212→S213 | | | |
| | ACC→AAG | T182→K183 | *ATT→ATC* | *I213→I214* | | | |
| | CCT→TCA | P183→S184 | GAT→TAT | D214→Y215 | | | |
| | AAG→CCT | K184→P185 | TCT→GAC | S215→D216 | | | |
| | ACC→CAA | T200→Q201 | ACT→AAG | T216→K217 | | | |
| | TTT→ATT | F209→I210 | TCT→--- | S217-- | | | |
| | ATG→TCA | M212→S213 | GAT→GAA | D218E | | | |
| | AAT→TAT | N214→Y215 | GAT→CAA | D219Q | | | |
| | TCA→GAC | S215→D216 | TTG→TCG | L220S | | | |
| | ACA→AAG | T216→K217 | GTT→AAG | V221K | | | |
| | AGT→--- | S217→--- | *GGT→GGG* | *G276G* | | | |
| | GAT→GAA | D218E | CCA→TCA | P281S | | | |
| | CAT→CAA | H219Q | TTG→TGC | L313C | | | |
| | TTA→TCG | L220S | TCT→ACG | S314T | | | |
| | TAC→AAG | Y221K | TTG→ATG | L315M | | | |
| | GAG→GAT | E238D | ACC→AGT | T317S | | | |
| | AAA→CAA | K252Q | *GAC→GAT* | *D329D* | | | |
| | CCT→TCA | P281S | AAG→CGA | K336R | | | |
| | CAA→AAA | Q292K | TTA→ATT | L337I | | | |
| | CTC→TGC | L313C | GGT→CGG | G357R | | | |
| | AGC→ACG | S314T | *AAA→AAG* | *K468K* | | | |
| | CTC→ATG | L315M | GAG→GAT | E484D | | | |
| | ACT→AGT | T317S | | | | | |
| | CAA→GCT | Q321A | | | | | |
| | GAA→GAT | E333D | | | | | |
| | AAA→CGA | K336R | | | | | |
| | TTG→ATT | L337I | | | | | |
| | GCT→ACA | A345T | | | | | |
| | GGA→CGG | G357R | | | | | |
| | AAT→ATT | N369I | | | | | |
| | TCT→TAC | S377Y | | | | | |
| | ACA→AGA | T405R | | | | | |
| | AAT→GGT | N429G | | | | | |
| | GCA→TCT | A436S | | | | | |
| | GAA→GAT | E484D | | | | | |
| | ACC→CCA | T501P | | | | | |
| | GAT→GAA | D536E | | | | | |
| V304 | AGA→AAA | R19K | AGA→AAA | R19K | 977 | 976 | |
| | AAA→CAA | K24Q | ACT→TTA | T53L | | | |
| | CAA→AAT | Q38N | GAT→GCA | D54A | | | |
| | ACA→TTA | T53L | GCA→ACC | A55T | | | |
| | GAT→GCA | D54A | GAA→GGA | E56G | | | |
| | GCT→ACC | A55T | GAT→AGG | D57R | | | |
| | GAA→GGA | E56G | CAA→AAA | Q58K | | | |
| | GAT→AGG | D57R | GCT→ATG | A85M | | | |
| | *AAG->AAA* | *K58K* | ATT→TTG | I86L | | | |
| | GTT→ATT | V60I | CAA→GAT | Q87D | | | |
| | GCA→ATG | A85M | CAA→CAC | Q88H | | | |
| | ATA→TTG | I86L | TTG→ATT | L89I | | | |

TABLE 43-continued

| CVS Variants | | | | | | | |
|---|---|---|---|---|---|---|---|
| Mutant | Nucleotide changes vs. wildtype | Amino acid changes vs. wildtype | Nucleotide changes vs. CVS V19 | Amino acid changes vs. CVS V19 | SEQ ID NO nt | SEQ ID NO aa | Valencene production % vs. V19 (Shake Flask) |
| | CAA→GAT | Q87D | TGT→TAC | C90Y | | | |
| | AAA→CAC | K88H | ---→AGA | ---→R91 | | | |
| | TTA→ATT | L89I | ---→GCT | ---→A92 | | | |
| | TGT→TAC | C90Y | ---→GAT | ---→D93 | | | |
| | ---→AGA | ---→R91 | *CCA→CCT* | *P91→P94* | | | |
| | ---→GCT | ---→A92 | ATT→TAT | I92→Y95 | | | |
| | ---→GAT | ---→D93 | CAT→TTT | H93→F96 | | | |
| | *CCA->CCT* | *P91->P94* | ATT→GAG | I94→E97 | | | |
| | ATC→TAT | I92→Y95 | GAT→GCT | D95→A98 | | | |
| | TAT→TTT | Y93→F96 | TCT→CAT | S96→H99 | | | |
| | ATT→GAG | I94→E97 | GAT→GAA | D97→E100 | | | |
| | GAC→GCT | D95→A98 | AAA→TAC | K98→Y101 | | | |
| | AGT→CAT | S96→H99 | GCT→AAT | A99→N102 | | | |
| | AAT→GAA | N97→E100 | *TCA→TCT* | *S174→S177* | | | |
| | AGA→TAC | R98→Y101 | TTG→--- | L175→--- | | | |
| | GCT→AAT | A99→N102 | GTT→--- | V176→--- | | | |
| | AAG→CAA | K125→Q128 | CAA→GCT | Q178→A179 | | | |
| | AAG→CAA | K173→Q176 | GAT→CCA | D179→P180 | | | |
| | *TCA->TCT* | *S174->S177* | GTT→TTG | V181→L182 | | | |
| | TTG→--- | L175→--- | ACT→AAG | T182→K183 | | | |
| | GTA→--- | V176→--- | CCA→TCA | P183→S184 | | | |
| | CAG→GCT | Q178→A179 | AGA→CCT | R184→P185 | | | |
| | GAT→CCA | D179→P180 | *GGT→GGG* | *G276→G277* | | | |
| | GTA→TTG | V181→L182 | CCA→TCA | P281→S282 | | | |
| | ACC→AAG | T182→K183 | TTG→TGT | L313→C314 | | | |
| | CCT→TCA | P183→S184 | TCT→ACG | S314→T315 | | | |
| | AAG→CCT | K184→P185 | TTG→ATG | L315→M316 | | | |
| | TTT→ATT | F209→I210 | ACC→AGT | T317→S318 | | | |
| | ATG→AGA | M212→R213 | *GAC→GAT* | *D329→D330* | | | |
| | AAT→GAT | N214→D215 | AAG→CGA | K336→R337 | | | |
| | CAT→GAT | H219→D220 | TTA→ATT | L337→I338 | | | |
| | TAC→GTT | Y221→V222 | GGT→CGG | G357→R358 | | | |
| | GAG→GAT | E238→D239 | CAA→CTA | Q448→L449 | | | |
| | AAA→CAA | K252→Q253 | GAG→GAT | E484→D485 | | | |
| | CCT→TCA | P281→S282 | | | | | |
| | CAA→AAA | Q292→K293 | | | | | |
| | CTC→TGT | L313→C314 | | | | | |
| | AGC→ACG | S314→T315 | | | | | |
| | CTC→ATG | L315→M316 | | | | | |
| | ACT→AGT | T317→S318 | | | | | |
| | CAA→GCT | Q321→A322 | | | | | |
| | GAA→GAT | E333→D334 | | | | | |
| | AAA→CGA | K336→R337 | | | | | |
| | TTG→ATT | L337→I338 | | | | | |
| | GCT→ACA | A345→T346 | | | | | |
| | GGA→CGG | G357→R358 | | | | | |
| | AAT→ATT | N369→I370 | | | | | |
| | TCT→TAC | S377→Y378 | | | | | |
| | ACA→AGA | T405→R406 | | | | | |
| | AAT→GGT | N429→G430 | | | | | |
| | GCA→TCT | A436→S437 | | | | | |
| | CAA→CTA | Q448→L449 | | | | | |
| | GAA→GAT | E484→D485 | | | | | |
| | ACC→CCA | T501→P502 | | | | | |
| | GAT→GAA | D536→E537 | | | | | |
| V305 | AGA→AAA | R19K | AGA→AAA | R19K | 979 | 978 | |
| | AAA→CAA | K24Q | ACT→TTA | T53L | | | |
| | CAA→AAT | Q38N | GAT→GCA | D54A | | | |
| | ACA→TTA | T53L | GCA→ACC | A55T | | | |
| | GAT→GCA | D54A | GAA→GGA | E56G | | | |
| | GCT→ACC | A55T | GAT→AGG | D57R | | | |
| | GAA→GGA | E56G | CAA→AAA | Q58K | | | |
| | GAT→AGG | D57R | GCT→ATG | A85M | | | |
| | *AAG->AAA* | *K58K* | ATT→TTG | I86L | | | |
| | GTT→ATT | V60I | CAA→GAT | Q87D | | | |
| | GCA→ATG | A85M | CAA→CAC | Q88H | | | |
| | ATA→TTG | I86L | TTG→ATT | L89I | | | |
| | CAA→GAT | Q87D | TGT→TAC | C90Y | | | |
| | AAA→CAC | K88H | ---→AGA | ---→R91 | | | |
| | TTA→ATT | L89I | ---→GCT | ---→A92 | | | |

TABLE 43-continued

| CVS Variants | | | | | | | |
|---|---|---|---|---|---|---|---|
| Mutant | Nucleotide changes vs. wildtype | Amino acid changes vs. wildtype | Nucleotide changes vs. CVS V19 | Amino acid changes vs. CVS V19 | SEQ ID NO nt | SEQ ID NO aa | Valencene production % vs. V19 (Shake Flask) |
| | TGT→TAC | C90Y | ---→GAT | ---→D93 | | | |
| | ---→AGA | ---→R91 | *CCA→CCT* | *P91→P94* | | | |
| | ---→GCT | ---→A92 | ATT→TAT | I92→Y95 | | | |
| | ---→GAT | ---→D93 | CAT→TTT | H93→F96 | | | |
| | *CCA->CCT* | *P91->P94* | ATT→GAG | I94→E97 | | | |
| | ATC→TAT | I92→Y95 | GAT→GCT | D95→A98 | | | |
| | TAT→TTT | Y93→F96 | TCT→CAT | S96→H99 | | | |
| | ATT→GAG | I94→E97 | GAT→GAA | D97→E100 | | | |
| | GAC→GCT | D95→A98 | AAA→TAC | K98→Y101 | | | |
| | AGT→CAT | S96→H99 | GCT→AAT | A99→N102 | | | |
| | AAT→GAA | N97→E100 | GAA→GAT | E163→D166 | | | |
| | AGA→TAC | R98→Y101 | *TCA→TCT* | *S174→S177* | | | |
| | GCT→AAT | A99→N102 | TTG→--- | L175→--- | | | |
| | AAG→CAA | K125→Q128 | GTT→--- | V176→--- | | | |
| | GAA→GAT | E163→D166 | CAA→GCT | Q178→A179 | | | |
| | AAG→CAA | K173→Q176 | GAT→CCA | D179→P180 | | | |
| | *TCA->TCT* | *S174->S177* | GTT→CTG | V181→L182 | | | |
| | TTG→--- | L175→--- | ACT→AAG | T182→K183 | | | |
| | GTA→--- | V176→--- | CCA→TCA | P183→S184 | | | |
| | CAG→GCT | Q178→A179 | AGA→CCT | R184→P185 | | | |
| | GAT→CCA | D179→P180 | *GGT→GGG* | *G276→G277* | | | |
| | GTA→CTG | V181→L182 | CCA→TCA | P281→S282 | | | |
| | ACC→AAG | T182→K183 | TTG→TGT | L313→C314 | | | |
| | CCT→TCA | P183→S184 | TCT→ACG | S314→T315 | | | |
| | AAG→CCT | K184→P185 | TTG→ATG | L315→M316 | | | |
| | TTT→ATT | F209→I210 | ACC→AGT | T317→S318 | | | |
| | ATG→AGA | M212→R213 | *GAC→GAT* | *D329→D330* | | | |
| | AAT→GAT | N214→D215 | AAG→CGA | K336→R337 | | | |
| | CAT→GAT | H219→D220 | TTA→ATT | L337→I338 | | | |
| | TAC→GTT | Y221→V222 | GGT→CGG | G357→R358 | | | |
| | GAG→GAT | E238→D239 | CAA→CTA | Q448→L449 | | | |
| | AAA→CAA | K252→Q253 | GAG→GAT | E484→D485 | | | |
| | CCT→TCA | P281→S282 | | | | | |
| | CAA→AAA | Q292→K293 | | | | | |
| | CTC→TGT | L313→C314 | | | | | |
| | AGC→ACG | S314→T315 | | | | | |
| | CTC→ATG | L315→M316 | | | | | |
| | ACT→AGT | T317→S318 | | | | | |
| | CAA→GCT | Q321→A322 | | | | | |
| | GAA→GAT | E333→D334 | | | | | |
| | AAA→CGA | K336→R337 | | | | | |
| | TTG→ATT | L337→I338 | | | | | |
| | GCT→ACA | A345→T346 | | | | | |
| | GGA→CGG | G357→R358 | | | | | |
| | AAT→ATT | N369→I370 | | | | | |
| | TCT→TAC | S377→Y378 | | | | | |
| | ACA→AGA | T405→R406 | | | | | |
| | AAT→GGT | N429→G430 | | | | | |
| | GCA→TCT | A436→S437 | | | | | |
| | CAA→CTA | Q448→L449 | | | | | |
| | GAA→GAT | E484→D485 | | | | | |
| | ACC→CCA | T501→P502 | | | | | |
| | GAT→GAA | D536→E537 | | | | | |
| V306 | AGA→AAA | R19K | AGA→AAA | R19K | 981 | 980 | |
| | AAA→CAA | K24Q | ACT→TTA | T53L | | | |
| | CAA→AAT | Q38N | GAT→GCA | D54A | | | |
| | ACA→TTA | T53L | GCA→ACC | A55T | | | |
| | GAT→GCA | D54A | GAA→GGA | E56G | | | |
| | GCT→ACC | A55T | GAT→AGG | D57R | | | |
| | GAA→GGA | E56G | CAA→AAA | Q58K | | | |
| | GAT→AGG | D57R | GCT→ATG | A85M | | | |
| | *AAG->AAA* | *K58K* | ATT→TTG | I86L | | | |
| | GTT→ATT | V60I | CAA→GAT | Q87D | | | |
| | GCA→ATG | A85M | CAA→CAC | Q88H | | | |
| | ATA→TTG | I86L | TTG→ATT | L89I | | | |
| | CAA→GAT | Q87D | TGT→TAC | C90Y | | | |
| | AAA→CAC | K88H | ---→AGA | ---→R91 | | | |
| | TTA→ATT | L89I | ---→GCT | ---→A92 | | | |
| | TGT→TAC | C90Y | ---→GAT | ---→D93 | | | |
| | ---→AGA | ---→R91 | *CCA→CCT* | *P91→P94* | | | |

TABLE 43-continued

| CVS Variants | | | | | | | |
|---|---|---|---|---|---|---|---|
| Mutant | Nucleotide changes vs. wildtype | Amino acid changes vs. wildtype | Nucleotide changes vs. CVS V19 | Amino acid changes vs. CVS V19 | SEQ ID NO nt | SEQ ID NO aa | Valencene production % vs. V19 (Shake Flask) |
| | ---→GCT | ---→A92 | ATT→TAT | I92→Y95 | | | |
| | ---→GAT | ---→D93 | CAT→TTT | H93→F96 | | | |
| | *CCA->CCT* | *P91->P94* | ATT→GAG | I94→E97 | | | |
| | ATC→TAT | I92→Y95 | GAT→GCT | D95→A98 | | | |
| | TAT→TTT | Y93→F96 | TCT→CAT | S96→H99 | | | |
| | ATT→GAG | I94→E97 | GAT→GAA | D97→E100 | | | |
| | GAC→GCT | D95→A98 | AAA→TAC | K98→Y101 | | | |
| | AGT→CAT | S96→H99 | GCT→AAT | A99→N102 | | | |
| | AAT→GAA | N97→E100 | *TCA→TCT* | *S174→S177* | | | |
| | AGA→TAC | R98→Y101 | TTG→--- | L175→--- | | | |
| | GCT→AAT | A99→N102 | GTT→--- | V176→--- | | | |
| | AAG→CAA | K125→Q128 | CAA→GCT | Q178→A179 | | | |
| | AAG→CAA | K173→Q176 | GAT→CCA | D179→P180 | | | |
| | *TCA->TCT* | *S174->S177* | GTT→TTG | V181→L182 | | | |
| | TTG→--- | L175→--- | ACT→AAG | T182→K183 | | | |
| | GTA→--- | V176→--- | CCA→TCA | P183→S184 | | | |
| | CAG→GCT | Q178→A179 | AGA→CCT | R184→P185 | | | |
| | GAT→CCA | D179→P180 | ATG→ACG | M210→T211 | | | |
| | GTA→TTG | V181→L182 | *TCA→TCT* | *S211→S212* | | | |
| | ACC→AAG | T182→K183 | *GGT→GGG* | *G276→G277* | | | |
| | CCT→TCA | P183→S184 | CCA→TCA | P281→S282 | | | |
| | AAG→CCT | K184→P185 | TTG→TGC | L313→C314 | | | |
| | TTT→ATT | F209→I210 | TCT→ACG | S314→T315 | | | |
| | ATG→ACG | M210→T211 | TTG→ATG | L315→M316 | | | |
| | *TCC->TCT* | *S211->S212* | ACC→AGT | T317→S318 | | | |
| | ATG→AGA | M212→R213 | *GAC→GAT* | *D329→D330* | | | |
| | AAT→GAT | N214→D215 | AAG→CGA | K336→R337 | | | |
| | CAT→GAT | H219→D220 | TTA→ATT | L337→I338 | | | |
| | TAC→GTT | Y221→V222 | GGT→CGG | G357→R358 | | | |
| | GAG→GAT | E238→D239 | *TTT→TTC* | *F383→F384* | | | |
| | AAA→CAA | K252→Q253 | GAG→GAT | E484→D485 | | | |
| | CCT→TCA | P281→S282 | CCA→CTA | P500→L501 | | | |
| | CAA→AAA | Q292→K293 | *TCT→TCC* | *S531→S532* | | | |
| | CTC→TGC | L313→C314 | | | | | |
| | AGC→ACG | S314→T315 | | | | | |
| | CTC→ATG | L315→M316 | | | | | |
| | ACT→AGT | T317→S318 | | | | | |
| | CAA→GCT | Q321→A322 | | | | | |
| | GAA→GAT | E333→D334 | | | | | |
| | AAA→CGA | K336→R337 | | | | | |
| | TTG→ATT | L337→I338 | | | | | |
| | GCT→ACA | A345→T346 | | | | | |
| | GGA→CGG | G357→R358 | | | | | |
| | AAT→ATT | N369→I370 | | | | | |
| | TCT→TAC | S377→Y378 | | | | | |
| | ACA→AGA | T405→R406 | | | | | |
| | AAT→GGT | N429→G430 | | | | | |
| | GCA→TCT | A436→S437 | | | | | |
| | GAA→GAT | E484→D485 | | | | | |
| | CCA→CTA | P500→L501 | | | | | |
| | ACC→CCA | T501→P502 | | | | | |
| | *TCT->TCC* | *S531->S532* | | | | | |
| | GAT→GAA | D536→E537 | | | | | |
| V307 | AGA→AAA | R19K | AGA→AAA | R19K | 983 | 982 | |
| | AAA→CAA | K24Q | ACT→TTA | T53L | | | |
| | CAA→AAT | Q38N | GAT→GCA | D54A | | | |
| | ACA→TTA | T53L | GCA→ACC | A55T | | | |
| | GAT→GCA | D54A | GAA→GGA | E56G | | | |
| | GCT→ACC | A55T | GAT→AGG | D57R | | | |
| | GAA→GGA | E56G | CAA→AAA | Q58K | | | |
| | GAT→AGG | D57R | GCT→ATG | A85M | | | |
| | *AAG->AAA* | *K58K* | ATT→TTG | I86L | | | |
| | GTT→ATT | V60I | CAA→GAT | Q87D | | | |
| | GCA→ATG | A85M | CAA→CAC | Q88H | | | |
| | ATA→TTG | I86L | TTG→ATT | L89I | | | |
| | CAA→GAT | Q87D | TGT→TAC | C90Y | | | |
| | AAA→CAC | K88H | ---→AGA | ---→R91 | | | |
| | TTA→ATT | L89I | ---→GCA | ---→A92 | | | |
| | TGT→TAC | C90Y | ---→GAT | ---→D93 | | | |
| | ---→AGA | ---→R91 | *CCA→CCT* | *P91→P94* | | | |

TABLE 43-continued

| CVS Variants | | | | | | | |
|---|---|---|---|---|---|---|---|
| Mutant | Nucleotide changes vs. wildtype | Amino acid changes vs. wildtype | Nucleotide changes vs. CVS V19 | Amino acid changes vs. CVS V19 | SEQ ID NO nt | SEQ ID NO aa | Valencene production % vs. V19 (Shake Flask) |
| | ---→GCA | ---→A92 | ATT→TAT | I92→Y95 | | | |
| | ---→GAT | ---→D93 | CAT→TTT | H93→F96 | | | |
| | *CCA->CCT* | *P91->P94* | ATT→GAG | I94→E97 | | | |
| | ATC→TAT | I92→Y95 | GAT→GCT | D95→A98 | | | |
| | TAT→TTT | Y93→F96 | TCT→CAT | S96→H99 | | | |
| | ATT→GAG | I94→E97 | GAT→GAA | D97→E100 | | | |
| | GAC→GCT | D95→A98 | AAA→TAC | K98→Y101 | | | |
| | AGT→CAT | S96→H99 | GCT→AAT | A99→N102 | | | |
| | AAT→GAA | N97→E100 | *CAA→CAG* | *Q142→Q145* | | | |
| | AGA→TAC | R98→Y101 | *TCA→TCT* | *S174→S177* | | | |
| | GCT→AAT | A99→N102 | TTG→--- | L175→--- | | | |
| | AAG→CAA | K125→Q128 | GTT→--- | V176→--- | | | |
| | *CAA->CAG* | *Q142->Q145* | CAA→GCT | Q178→A179 | | | |
| | AAG→CAA | K173→Q176 | GAT→CCA | D179→P180 | | | |
| | *TCA->TCT* | *S174->S177* | GTT→TTG | V181→L182 | | | |
| | TTG→--- | L175→--- | ACT→AAG | T182→K183 | | | |
| | GTA→--- | V176→--- | CCA→TCA | P183→S184 | | | |
| | CAG→GCT | Q178→A179 | AGA→CCT | R184→P185 | | | |
| | GAT→CCA | D179→P180 | *GGT→GGG* | *G276→G277* | | | |
| | GTA→TTG | V181→L182 | CCA→TCA | P281→S282 | | | |
| | ACC→AAG | T182→K183 | TTG→TGC | L313→C314 | | | |
| | CCT→TCA | P183→S184 | TCT→ACG | S314→T315 | | | |
| | AAG→CCT | K184→P185 | TTG→ATG | L315→M316 | | | |
| | TTT→ATT | F209→I210 | ACC→AGT | T317→S318 | | | |
| | ATG→AGA | M212→R213 | *GAC→GAT* | *D329→D330* | | | |
| | AAT→GAT | N214→D215 | AAG→CGA | K336→R337 | | | |
| | CAT→GAT | H219→D220 | TTA→ATT | L337→I338 | | | |
| | TAC→GTT | Y221→V222 | GGT→CGG | G357→R358 | | | |
| | GAG→GAT | E238→D239 | GAG→GAT | E484→D485 | | | |
| | AAA→CAA | K252→Q253 | *GCA→GCG* | *A539→A540* | | | |
| | CCT→TCA | P281→S282 | | | | | |
| | CAA→AAA | Q292→K293 | | | | | |
| | CTC→TGC | L313→C314 | | | | | |
| | AGC→ACG | S314→T315 | | | | | |
| | CTC→ATG | L315→M316 | | | | | |
| | ACT→AGT | T317→S318 | | | | | |
| | CAA→GCT | Q321→A322 | | | | | |
| | GAA→GAT | E333→D334 | | | | | |
| | AAA→CGA | K336→R337 | | | | | |
| | TTG→ATT | L337→I338 | | | | | |
| | GCT→ACA | A345→T346 | | | | | |
| | GGA→CGG | G357→R358 | | | | | |
| | AAT→ATT | N369→I370 | | | | | |
| | TCT→TAC | S377→Y378 | | | | | |
| | ACA→AGA | T405→R406 | | | | | |
| | AAT→GGT | N429→G430 | | | | | |
| | GCA→TCT | A436→S437 | | | | | |
| | GAA→GAT | E484→D485 | | | | | |
| | ACC→CCA | T501→P502 | | | | | |
| | GAT→GAA | D536→E537 | | | | | |
| | *GCT->GCG* | *A539->A540* | | | | | |
| V308 | AGA→AAA | R19K | AGA→AAA | R19K | 985 | 984 | |
| | AAC→GAC | N20D | AAT→GAC | N20D | | | |
| | CTC→TCG | L23S | TTG→TCG | L23S | | | |
| | AAA→CAA | K24Q | ACT→TTA | T53L | | | |
| | CAA→AAT | Q38N | GAT→GCA | D54A | | | |
| | ACA→TTA | T53L | GCA→ACC | A55T | | | |
| | GAT→GCA | D54A | GAA→GGA | E56G | | | |
| | GCT→ACC | A55T | GAT→AGG | D57R | | | |
| | GAA→GGA | E56G | CAA→AAA | Q58K | | | |
| | GAT→AGG | D57R | *GAA→GAG* | *E68E* | | | |
| | *AAG->AAA* | *K58K* | GCT→ATG | A85M | | | |
| | GTT→ATT | V60I | ATT→TTG | I86L | | | |
| | *GAA->GAG* | *E68E* | CAA→GAT | Q87D | | | |
| | GCA→ATG | A85M | CAA→CAC | Q88H | | | |
| | ATA→TTG | I86L | TTG→ATT | L89I | | | |
| | CAA→GAT | Q87D | TGT→TAC | C90Y | | | |
| | AAA→CAC | K88H | ---→AGA | ---→R91 | | | |
| | TTA→ATT | L89I | ---→GCT | ---→A92 | | | |
| | TGT→TAC | C90Y | ---→GAT | ---→D93 | | | |
| | ---→AGA | ---→R91 | *CCA→CCT* | *P91→P94* | | | |

TABLE 43-continued

CVS Variants

| Mutant | Nucleotide changes vs. wildtype | Amino acid changes vs. wildtype | Nucleotide changes vs. CVS V19 | Amino acid changes vs. CVS V19 | SEQ ID NO nt | SEQ ID NO aa | Valencene production % vs. V19 (Shake Flask) |
|---|---|---|---|---|---|---|---|
| | ---→GCT | ---→A92 | ATT→TAT | I92→Y95 | | | |
| | ---→GAT | ---→D93 | CAT→TTT | H93→F96 | | | |
| | *CCA->CCT* | *P91->P94* | ATT→GAG | I94→E97 | | | |
| | ATC→TAT | I92→Y95 | GAT→GCT | D95→A98 | | | |
| | TAT→TTT | Y93→F96 | TCT→CAT | S96→H99 | | | |
| | ATT→GAG | I94→E97 | GAT→GAA | D97→E100 | | | |
| | GAC→GCT | D95→A98 | AAA→TAC | K98→Y101 | | | |
| | AGT→CAT | S96→H99 | GCT→AAT | A99→N102 | | | |
| | AAT→GAA | N97→E100 | CAA→GAA | Q173→E176 | | | |
| | AGA→TAC | R98→Y101 | *TCA→TCT* | *S174→S177* | | | |
| | GCT→AAT | A99→N102 | TTG→--- | L175→--177 | | | |
| | AAG→CAA | K125→Q128 | GTT→--- | V176→--177 | | | |
| | AAG→GAA | K173→E176 | CAA→GCT | Q178→A179 | | | |
| | *TCA->TCT* | *S174->S177* | GAT→CCA | D179→P180 | | | |
| | TTG→--- | L175→--- | GTT→TTG | V181→L182 | | | |
| | GTA→--- | V176→--- | ACT→AAG | T182→K183 | | | |
| | CAG→GCT | Q178→A179 | CCA→TCA | P183→S184 | | | |
| | GAT→CCA | D179→P180 | AGA→CCT | R184→P185 | | | |
| | GTA→TTG | V181→L182 | *GGT→GGG* | *G276→G277* | | | |
| | ACC→AAG | T182→K183 | CCA→TCA | P281→S282 | | | |
| | CCT→TCA | P183→S184 | TTG→TGC | L313→C314 | | | |
| | AAG→CCT | K184→P185 | TCT→ACG | S314→T315 | | | |
| | TTT→ATT | F209→I210 | TTG→ATG | L315→M316 | | | |
| | ATG→AGA | M212→R213 | ACC→AGT | T317→S318 | | | |
| | AAT→GAT | N214→D215 | *GAC→GAT* | *D329→D330* | | | |
| | CAT→GAT | H219→D220 | AAG→CGA | K336→R337 | | | |
| | TAC→GTT | Y221→V222 | TTA→ATT | L337→I338 | | | |
| | GAG→GAT | E238→D239 | GGT→CGG | G357→R358 | | | |
| | AAA→CAA | K252→Q253 | TGC→AGC | C465→S466 | | | |
| | CCT→TCA | P281→S282 | GAG→GAT | E484→D485 | | | |
| | CAA→AAA | Q292→K293 | *GGT→GGG* | *G527→G528* | | | |
| | CTC→TGC | L313→C314 | GCA→GTA | A539→V540 | | | |
| | AGC→ACG | S314→T315 | | | | | |
| | CTC→ATG | L315→M316 | | | | | |
| | ACT→AGT | T317→S318 | | | | | |
| | CAA→GCT | Q321→A322 | | | | | |
| | GAA→GAT | E333→D334 | | | | | |
| | AAA→CGA | K336→R337 | | | | | |
| | TTG→ATT | L337→I338 | | | | | |
| | GCT→ACA | A345→T346 | | | | | |
| | GGA→CGG | G357→R358 | | | | | |
| | AAT→ATT | N369→I370 | | | | | |
| | TCT→TAC | S377→Y378 | | | | | |
| | ACA→AGA | T405→R406 | | | | | |
| | AAT→GGT | N429→G430 | | | | | |
| | GCA→TCT | A436→S437 | | | | | |
| | TGT→AGC | C465→S466 | | | | | |
| | GAA→GAT | E484→D485 | | | | | |
| | ACC→CCA | T501→P502 | | | | | |
| | *GGC->GGG* | *G527->G528* | | | | | |
| | GAT→GAA | D536→E537 | | | | | |
| | GCT→GTA | A539→V540 | | | | | |
| V309 | TCG→TGC | S2C | TCA→TGC | S2C | 987 | 986 | 71 |
| | TCT→ATG | S3M | TCT→ATG | S3M | | | |
| | GGA→ACA | G4T | GGT→ACA | G4T | | | |
| | GAA→GGT | E5G | GAA→GGT | E5G | | | |
| | ACA→GAA | T6E | ACT→GAA | T6E | | | |
| | TTT→TCG | F7S | TTT→TCG | F7S | | | |
| | AGA→AAA | R19K | AGA→AAA | R19K | | | |
| | AAA→CAA | K24Q | ACT→TTA | T53L | | | |
| | CAA→AAT | Q38N | GAT→GCA | D54A | | | |
| | ACA→TTA | T53L | GCA→ACC | A55T | | | |
| | GAT→GCA | D54A | GAA→GGA | E56G | | | |
| | GCT→ACC | A55T | GAT→AGG | D57R | | | |
| | GAA→GGA | E56G | CAA→AAA | Q58K | | | |
| | GAT→AGG | D57R | GCT→ATG | A85M | | | |
| | *AAG->AAA* | *K58K* | ATT→TTG | I86L | | | |
| | GTT→ATT | V60I | CAA→GAT | Q87D | | | |
| | GCA→ATG | A85M | CAA→CAC | Q88H | | | |
| | ATA→TTG | I86L | TTG→ATT | L89I | | | |

TABLE 43-continued

| CVS Variants | | | | | | | |
|---|---|---|---|---|---|---|---|
| Mutant | Nucleotide changes vs. wildtype | Amino acid changes vs. wildtype | Nucleotide changes vs. CVS V19 | Amino acid changes vs. CVS V19 | SEQ ID NO nt | SEQ ID NO aa | Valencene production % vs. V19 (Shake Flask) |
| | CAA→GAT | Q87D | TGT→TAC | C90Y | | | |
| | AAA→CAC | K88H | ---→AGA | ---→R91 | | | |
| | TTA→ATT | L89I | ---→GCT | ---→A92 | | | |
| | TGT→TAC | C90Y | ---→GAT | ---→D93 | | | |
| | ---→AGA | ---→R91 | *CCA→CCT* | *P91→P94* | | | |
| | ---→GCT | ---→A92 | ATT→TAT | I92→Y95 | | | |
| | ---→GAT | ---→D93 | CAT→TTT | H93→F96 | | | |
| | *CCA->CCT* | *P91->P94* | ATT→GAG | I94→E97 | | | |
| | ATC→TAT | I92→Y95 | GAT→GCT | D95→A98 | | | |
| | TAT→TTT | Y93→F96 | TCT→CAT | S96→H99 | | | |
| | ATT→GAG | I94→E97 | GAT→GAA | D97→E100 | | | |
| | GAC→GCT | D95→A98 | AAA→TAC | K98→Y101 | | | |
| | AGT→CAT | S96→H99 | GCT→AAT | A99→N102 | | | |
| | AAT→GAA | N97→E100 | *TCA→TCT* | *S174→S177* | | | |
| | AGA→TAC | R98→Y101 | TTG→--- | L175→--- | | | |
| | GCT→AAT | A99→N102 | GTT→--- | V176→--- | | | |
| | AAG→CAA | K125→Q128 | CAA→GCT | Q178→A179 | | | |
| | AAG→CAA | K173→Q176 | GAT→CCA | D179→P180 | | | |
| | *TCA->TCT* | *S174->S177* | GTT→TTG | V181→L182 | | | |
| | TTG→--- | L175→--- | ACT→AAG | T182→K183 | | | |
| | GTA→--- | V176→--- | CCA→TCA | P183→S184 | | | |
| | CAG→GCT | Q178→A179 | AGA→CCT | R184→P185 | | | |
| | GAT→CCA | D179→P180 | AGA→TCA | R212→S213 | | | |
| | GTA→TTG | V181→L182 | *ATT→ATC* | *I213→I214* | | | |
| | ACC→AAG | T182→K183 | GAT→TAT | D214→Y215 | | | |
| | CCT→TCA | P183→S184 | TCT→GAC | S215→D216 | | | |
| | AAG→CCT | K184→P185 | ACT→AAG | T216→K217 | | | |
| | TTT→ATT | F209→I210 | TCT→--- | S217→--- | | | |
| | ATG→TCA | M212→S213 | GAT→GAA | D218E | | | |
| | AAT→TAT | N214→Y215 | GAT→CAA | D219Q | | | |
| | TCA→GAC | S215→D216 | TTG→TCG | L220S | | | |
| | ACA→AAG | T216→K217 | GTT→AAG | V221K | | | |
| | AGT→--- | S217→--- | *GGT→GGG* | *G276G* | | | |
| | GAT→GAA | D218E | CCA→TCA | P281S | | | |
| | CAT→CAA | H219Q | TTG→TGC | L313C | | | |
| | TTA→TCG | L220S | TCT→ACG | S314T | | | |
| | TAC→AAG | Y221K | TTG→ATG | L315M | | | |
| | GAG→GAT | E238D | ACC→AGT | T317S | | | |
| | AAA→CAA | K252Q | *GAC→GAT* | *D329D* | | | |
| | CCT→TCA | P281S | AAG→CGA | K336R | | | |
| | CAA→AAA | Q292K | TTA→ATT | L337I | | | |
| | CTC→TGC | L313C | GAA→GCT | E348A | | | |
| | AGC→ACG | S314T | GGT→CGG | G357R | | | |
| | CTC→ATG | L315M | GAG→GAT | E484D | | | |
| | ACT→AGT | T317S | | | | | |
| | CAA→GCT | Q321A | | | | | |
| | GAA→GAT | E333D | | | | | |
| | AAA→CGA | K336R | | | | | |
| | TTG→ATT | L337I | | | | | |
| | GCT→ACA | A345T | | | | | |
| | GAA→GCT | E348A | | | | | |
| | GGA→CGG | G357R | | | | | |
| | AAT→ATT | N369I | | | | | |
| | TCT→TAC | S377Y | | | | | |
| | ACA→AGA | T405R | | | | | |
| | AAT→GGT | N429G | | | | | |
| | GCA→TCT | A436S | | | | | |
| | GAA→GAT | E484D | | | | | |
| | ACC→CCA | T501P | | | | | |
| | GAT→GAA | D536E | | | | | |
| V310 | TCG→TGC | S2C | TCA→TGC | S2C | 989 | 988 | 64 |
| | TCT→ATG | S3M | TCT→ATG | S3M | | | |
| | GGA→ACA | G4T | GGT→ACA | G4T | | | |
| | GAA→GGT | E5G | GAA→GGT | E5G | | | |
| | ACA→GAA | T6E | ACT→GAA | T6E | | | |
| | TTT→TCG | F7S | TTT→TCG | F7S | | | |
| | AGA→AAA | R19K | AGA→AAA | R19K | | | |
| | AAA→CAA | K24Q | ACT→TTA | T53L | | | |
| | CAA→AAT | Q38N | GAT→GCA | D54A | | | |
| | ACA→TTA | T53L | GCA→ACC | A55T | | | |

TABLE 43-continued

| CVS Variants | | | | | | | |
|---|---|---|---|---|---|---|---|
| Mutant | Nucleotide changes vs. wildtype | Amino acid changes vs. wildtype | Nucleotide changes vs. CVS V19 | Amino acid changes vs. CVS V19 | SEQ ID NO nt | SEQ ID NO aa | Valencene production % vs. V19 (Shake Flask) |
| | GAT→GCA | D54A | GAA→GGA | E56G | | | |
| | GCT→ACC | A55T | GAT→AGG | D57R | | | |
| | GAA→GGA | E56G | CAA→AAA | Q58K | | | |
| | GAT→AGG | D57R | GCT→ATG | A85M | | | |
| | *AAG->AAA* | *K58K* | ATT→TTG | I86L | | | |
| | GTT→ATT | V60I | CAA→GAT | Q87D | | | |
| | GCA→ATG | A85M | CAA→CAC | Q88H | | | |
| | ATA→TTG | I86L | TTG→ATT | L89I | | | |
| | CAA→GAT | Q87D | TGT→TAC | C90Y | | | |
| | AAA→CAC | K88H | ---→AGA | ---→R91 | | | |
| | TTA→ATT | L89I | ---→GCT | ---→A92 | | | |
| | TGT→TAC | C90Y | ---→GAT | ---→D93 | | | |
| | ---→AGA | ---→R91 | *CCA→CCT* | *P91→P94* | | | |
| | ---→GCT | ---→A92 | ATT→TAT | I92→Y95 | | | |
| | ---→GAT | ---→D93 | CAT→TTT | H93→F96 | | | |
| | *CCA->CCT* | *P91->P94* | ATT→GAG | I94→E97 | | | |
| | ATC→TAT | I92→Y95 | GAT→GCT | D95→A98 | | | |
| | TAT→TTT | Y93→F96 | TCT→CAT | S96→H99 | | | |
| | ATT→GAG | I94→E97 | GAT→GAA | D97→E100 | | | |
| | GAC→GCT | D95→A98 | AAA→TAC | K98→Y101 | | | |
| | AGT→CAT | S96→H99 | GCT→AAT | A99→N102 | | | |
| | AAT→GAA | N97→E100 | *TCA→TCT* | *S174→S177* | | | |
| | AGA→TAC | R98→Y101 | TTG→--- | L175→--- | | | |
| | GCT→AAT | A99→N102 | GTT→--- | V176→--- | | | |
| | AAG→CAA | K125→Q128 | CAA→GCT | Q178→A179 | | | |
| | AAG→CAA | K173→Q176 | GAT→CCA | D179→P180 | | | |
| | *TCA->TCT* | *S174->S177* | GTT→TTG | V181→L182 | | | |
| | TTG→--- | L175→--- | ACT→AAG | T182→K183 | | | |
| | GTA→--- | V176→--- | CCA→TCA | P183→S184 | | | |
| | CAG→GCT | Q178→A179 | AGA→CCT | R184→P185 | | | |
| | GAT→CCA | D179→P180 | AGA→TCA | R212→S213 | | | |
| | GTA→TTG | V181→L182 | *ATT→ATC* | *I213→I214* | | | |
| | ACC→AAG | T182→K183 | GAT→TAT | D214→Y215 | | | |
| | CCT→TCA | P183→S184 | TCT→GAC | S215→D216 | | | |
| | AAG→CCT | K184→P185 | ACT→AAG | T216→K217 | | | |
| | TTT→ATT | F209→I210 | TCT→--- | S217→--- | | | |
| | ATG→TCA | M212→S213 | GAT→GAA | D218E | | | |
| | AAT→TAT | N214→Y215 | GAT→CAA | D219Q | | | |
| | TCA→GAC | S215→D216 | TTG→TCG | L220S | | | |
| | ACA→AAG | T216→K217 | GTT→AAG | V221K | | | |
| | AGT→--- | S217→--- | *GGT→GGG* | *G276G* | | | |
| | GAT→GAA | D218E | CCA→TCA | P281S | | | |
| | CAT→CAA | H219Q | TTG→TGC | L313C | | | |
| | TTA→TCG | L220S | TCT→ACG | S314T | | | |
| | TAC→AAG | Y221K | TTG→ATG | L315M | | | |
| | GAG→GAT | E238D | ACC→AGT | T317S | | | |
| | AAA→CAA | K252Q | *GAC→GAT* | *D329D* | | | |
| | CCT→TCA | P281S | AAG→CGA | K336R | | | |
| | CAA→AAA | Q292K | TTA→ATT | L337I | | | |
| | CTC→TGC | L313C | GAA→TCA | E348S | | | |
| | AGC→ACG | S314T | GGT→CGG | G357R | | | |
| | CTC→ATG | L315M | GAG→GAT | E484D | | | |
| | ACT→AGT | T317S | | | | | |
| | CAA→GCT | Q321A | | | | | |
| | GAA→GAT | E333D | | | | | |
| | AAA→CGA | K336R | | | | | |
| | TTG→ATT | L337I | | | | | |
| | GCT→ACA | A345T | | | | | |
| | GAA→TCA | E348S | | | | | |
| | GGA→CGG | G357R | | | | | |
| | AAT→ATT | N369I | | | | | |
| | TCT→TAC | S377Y | | | | | |
| | ACA→AGA | T405R | | | | | |
| | AAT→GGT | N429G | | | | | |
| | GCA→TCT | A436S | | | | | |
| | GAA→GAT | E484D | | | | | |
| | ACC→CCA | T501P | | | | | |
| | GAT→GAA | D536E | | | | | |
| V311 | AAA→CAA | K24Q | CCA→AAT | P91N | 991 | 990 | 104.3 |
| | CAA→AAT | Q38N | ATT→AGT | I92S | | | |

TABLE 43-continued

| CVS Variants | | | | | | | |
|---|---|---|---|---|---|---|---|
| Mutant | Nucleotide changes vs. wildtype | Amino acid changes vs. wildtype | Nucleotide changes vs. CVS V19 | Amino acid changes vs. CVS V19 | SEQ ID NO nt | SEQ ID NO aa | Valencene production % vs. V19 (Shake Flask) |
| | AAG→CAA | K58Q | CAT→TTT | H93F | | | |
| | GTT→ATT | V60I | ATT→CAT | I94H | | | |
| | AAA→CAA | K88Q | *GAT→GAC* | *D95D* | | | |
| | CCA→AAT | P91N | TCT→TGC | S96C | | | |
| | ATC→AGT | I92S | GAT→AAT | D97N | | | |
| | TAT→TTT | Y93F | AAA→GAT | K98D | | | |
| | ATT→CAT | I94H | GCT→ATG | A99M | | | |
| | AGT→TGC | S96C | ---→GGT | ---→G101 | | | |
| | AGA→GAT | R98D | ---→GAT | ---→D102 | | | |
| | GCT→ATG | A99M | | | | | |
| | ---→GGT | ---→G101 | | | | | |
| | ---→GAT | ---→D102 | | | | | |
| | AAG→CAA | K125→Q127 | | | | | |
| | AAG→CAA | K173→Q175 | | | | | |
| | AAG→AGA | K184→R186 | | | | | |
| | TTT→ATT | F209→I211 | | | | | |
| | ATG→AGA | M212→R214 | | | | | |
| | AAT→GAT | N214→D216 | | | | | |
| | CAT→GAT | H219→D221 | | | | | |
| | TAC→GTT | Y221→V223 | | | | | |
| | GAG→GAT | E238→D240 | | | | | |
| | AAA→CAA | K252→Q254 | | | | | |
| | CAA→AAA | Q292→K294 | | | | | |
| | CAA→GCT | Q321→A323 | | | | | |
| | GAA→GAT | E333→D335 | | | | | |
| | GCT→ACA | A345→T347 | | | | | |
| | AAT→ATT | N369→I371 | | | | | |
| | TCT→TAC | S377→Y379 | | | | | |
| | ACA→AGA | T405→R407 | | | | | |
| | AAT→GGT | N429→G431 | | | | | |
| | GCA→TCT | A436→S438 | | | | | |
| | ACC→CCA | T501→P503 | | | | | |
| | GAT→GAA | D536→E538 | | | | | |
| V312 | AAA→CAA | K24Q | ATT→GTT | I82V | 993 | 992 | 85.9 |
| | CAA→AAT | Q38N | CCA→AAT | P91N | | | |
| | AAG→CAA | K58Q | ATT→AGT | I92S | | | |
| | GTT→ATT | V60I | CAT→TTT | H93F | | | |
| | ATA→GTT | I82V | ATT→CAT | I94H | | | |
| | AAA→CAA | K88Q | *GAT→GAC* | *D95D* | | | |
| | CCA→AAT | P91N | TCT→TGC | S96C | | | |
| | ATC→AGT | I92S | GAT→AAT | D97N | | | |
| | TAT→TTT | Y93F | AAA→GAT | K98D | | | |
| | ATT→CAT | I94H | GCT→ATG | A99M | | | |
| | AGT→TGC | S96C | ---→GGT | ---→G101 | | | |
| | AGA→GAT | R98D | ---→GAT | ---→D102 | | | |
| | GCT→ATG | A99M | TTG→TCG | L399→S401 | | | |
| | ---→GGT | ---→G101 | | | | | |
| | ---→GAT | ---→D102 | | | | | |
| | AAG→CAA | K125→Q127 | | | | | |
| | AAG→CAA | K173→Q175 | | | | | |
| | AAG→AGA | K184→R186 | | | | | |
| | TTT→ATT | F209→I211 | | | | | |
| | ATG→AGA | M212→R214 | | | | | |
| | AAT→GAT | N214→D216 | | | | | |
| | CAT→GAT | H219→D221 | | | | | |
| | TAC→GTT | Y221→V223 | | | | | |
| | GAG→GAT | E238→D240 | | | | | |
| | AAA→CAA | K252→Q254 | | | | | |
| | CAA→AAA | Q292→K294 | | | | | |
| | CAA→GCT | Q321→A323 | | | | | |
| | GAA→GAT | E333→D335 | | | | | |
| | GCT→ACA | A345→T347 | | | | | |
| | AAT→ATT | N369→I371 | | | | | |
| | TCT→TAC | S377→Y379 | | | | | |
| | CTA→TCG | L399→S401 | | | | | |
| | ACA→AGA | T405→R407 | | | | | |
| | AAT→GGT | N429→G431 | | | | | |
| | GCA→TCT | A436→S438 | | | | | |
| | ACC→CCA | T501→P503 | | | | | |
| | GAT→GAA | D536→E538 | | | | | |

TABLE 43-continued

| CVS Variants | | | | | | | |
|---|---|---|---|---|---|---|---|
| Mutant | Nucleotide changes vs. wildtype | Amino acid changes vs. wildtype | Nucleotide changes vs. CVS V19 | Amino acid changes vs. CVS V19 | SEQ ID NO nt | SEQ ID NO aa | Valencene production % vs. V19 (Shake Flask) |
| V313 | *TCG->TCT* | *S2S* | *TCA→TCT* | *S2S* | 995 | 994 | 75 |
| | TCT→ACT | S3T | TCT→ACT | S3T | | | |
| | GGA→CAA | G4Q | GGT→CAA | G4Q | | | |
| | GAA→GTC | E5V | GAA→GTC | E5V | | | |
| | ---→TCA | ---→S6 | ---→TCA | ---→S6 | | | |
| | ---→GCA | ---→A7 | ---→GCA | ---→A7 | | | |
| | ---→TCT | ---→S8 | ---→TCT | ---→S8 | | | |
| | ---→TCT | ---→S9 | ---→TCT | ---→S9 | | | |
| | ---→CTA | ---→L10 | ---→CTA | ---→L10 | | | |
| | ---→GCC | ---→A11 | ---→GCC | ---→A11 | | | |
| | ---→CAG | ---→Q12 | ---→CAG | ---→Q12 | | | |
| | ---→ATT | ---→I13 | ---→ATT | ---→I13 | | | |
| | ---→CCC | ---→P14 | ---→CCC | ---→P14 | | | |
| | ---→CAA | ---→Q15 | ---→CAA | ---→Q15 | | | |
| | ---→CCC | ---→P16 | ---→CCC | ---→P16 | | | |
| | ACA→AAA | T6→K17 | ACT→AAA | T6→K17 | | | |
| | TTT→AAT | F7→N18 | TTT→AAT | F7→N18 | | | |
| | ACT→GTG | T10→V21 | *AGA→CGT* | *R8→R19* | | | |
| | GAT→AAC | D12→N23 | *CCA→CCT* | *P9→P20* | | | |
| | *CAT->CAC* | *H14->H25* | ACT→GTG | T10→V21 | | | |
| | *CCT->CCC* | *P15->P26* | *GCT→GCA* | *A11→A22* | | | |
| | AGT→AAC | S16→N27 | GAT→AAC | D12→N23 | | | |
| | TTA→ATT | L17→I28 | *CAT→CAC* | *H14→H25* | | | |
| | AGA→GGT | R19→G30 | *CCA→CCC* | *P15→P26* | | | |
| | AAC→GAC | N20→D31 | TCT→AAC | S16→N27 | | | |
| | CAT→CAA | H21→Q32 | TTG→ATT | L17→I28 | | | |
| | CTC→ATC | L23→I34 | AGA→GGT | R19→G30 | | | |
| | AAA→ACC | K24→T35 | AAT→GAC | N20→D31 | | | |
| | GGT→TAC | G25→Y36 | CAT→CAA | H21→Q32 | | | |
| | GCT→ACT | A26→T37 | TTG→ATC | L23→I34 | | | |
| | TCT→CCT | S27→P38 | CAA→ACC | Q24→T35 | | | |
| | GAT→GAA | D28→E39 | GGT→TAC | G25→Y36 | | | |
| | TTC→GAC | F29→D40 | GCA→ACT | A26→T37 | | | |
| | ACA→--- | T31→--- | TCA→CCT | S27→P38 | | | |
| | GAT→ACT | D33→T43 | GAT→GAA | D28→E39 | | | |
| | CAT→CGT | H34→R44 | TTT→GAC | F29→D40 | | | |
| | ACT→GCC | T35→A45 | ACT→--- | T31→--- | | | |
| | GCA→TGC | A36→C46 | GAT→ACT | D33→T43 | | | |
| | ACT→AAA | T37→K47 | CAT→CGT | H34→R44 | | | |
| | CAA→GAG | Q38→E48 | ACA→GCC | T35→A45 | | | |
| | *GAA->GAG* | *E39->E49* | GCT→TGC | A36→C46 | | | |
| | CGA→CAG | R40→Q50 | ACA→AAA | T37→K47 | | | |
| | CAC→ATT | H41→I51 | AAT→GAG | N38→E48 | | | |
| | GTA→ATT | V48→I58 | *GAA→GAG* | *E39→E49* | | | |
| | ACA→TTA | T53→L63 | AGA→CAG | R40→Q50 | | | |
| | GAT→GCA | D54→A64 | CAT→ATT | H41→I51 | | | |
| | GCT→ACC | A55→T65 | GTT→ATT | V48→I58 | | | |
| | GAA→GGA | E56→G66 | ACT→TTA | T53→L63 | | | |
| | GAT→AGG | D57→R67 | GAT→GCA | D54→A64 | | | |
| | GTT→ATT | V60→I70 | GCA→ACC | A55→T65 | | | |
| | ATA→TTA | I86→L96 | GAA→GGA | E56→G66 | | | |
| | AAA→CAT | K88→H98 | GAT→AGG | D57→R67 | | | |
| | TTA→ATT | L89→I99 | CAA→AAA | Q58→K68 | | | |
| | CCA→AAT | P91→N101 | *GCT→GCA* | *A85→A95* | | | |
| | ATC→AGT | I92→S102 | ATT→TTA | I86→L96 | | | |
| | TAT→TTT | Y93→F103 | CAA→CAT | Q88→H98 | | | |
| | ATT→CAT | I94→H104 | TTG→ATT | L89→I99 | | | |
| | AGT→TGC | S96→C106 | CCA→AAT | P91→N101 | | | |
| | AGA→GAT | R98→D108 | ATT→AGT | I92→S102 | | | |
| | GCT→ATG | A99→M109 | CAT→TTT | H93→F103 | | | |
| | ---→GGT | ---→G111 | ATT→CAT | I94→H104 | | | |
| | ---→GAT | ---→D112 | *GAT→GAC* | *D95→D105* | | | |
| | CAC→TAT | H102→Y114 | TCT→TGC | S96→C106 | | | |
| | *GGA->GGG* | *G115->G127* | GAT→AAT | D97→N107 | | | |
| | ATC→TAC | I116→Y128 | AAA→GAT | K98→D108 | | | |
| | AAG→ACT | K117→T129 | GCT→ATG | A99→M109 | | | |
| | GTG→ATA | V122→I134 | ---→GGT | ---→G111 | | | |
| | GAG→AAC | E124→N136 | ---→GAT | ---→D112 | | | |
| | AAA→ACG | K127→T139 | CAT→TAT | H102→Y114 | | | |
| | GAT→GAA | D129→E141 | *GGT→GGG* | *G115→G127* | | | |

TABLE 43-continued

| CVS Variants | | | | | | | |
|---|---|---|---|---|---|---|---|
| Mutant | Nucleotide changes vs. wildtype | Amino acid changes vs. wildtype | Nucleotide changes vs. CVS V19 | Amino acid changes vs. CVS V19 | SEQ ID NO nt | SEQ ID NO aa | Valencene production % vs. V19 (Shake Flask) |
| | GAG→CGA | E130→R142 | ATT→TAC | I116→Y128 | | | |
| | TCA→GAA | S135→E147 | AAG→ACT | K117→T129 | | | |
| | TCG→GCT | S136→A148 | *TCT→TCA* | *S119→S131* | | | |
| | *ATA->ATC* | *I138->I150* | GTT→ATA | V122→I134 | | | |
| | AAC→AGC | N139→S151 | GAA→AAC | E124→N136 | | | |
| | *GTT->GTA* | *V141->V153* | CAA→AAG | Q125→K137 | | | |
| | CAA→AGA | Q142→R154 | AAG→ACG | K127→T139 | | | |
| | *TTA->CTA* | *L145->L157* | GAT→GAA | D129→E141 | | | |
| | AGT→GGC | S146→G158 | GAA→CGA | E130→R142 | | | |
| | AAG→CAA | K173→Q185 | *AAA→AAG* | *K134→K146* | | | |
| | *TCA->TCT* | *S174->S186* | AGT→GAA | S135→E147 | | | |
| | TTG→--- | L175→--- | TCT→GCT | S136→A148 | | | |
| | GTA→--- | V176→--- | *ATT→ATC* | *I138→I150* | | | |
| | CAG→GCT | Q178→A188 | AAT→AGC | N139→S151 | | | |
| | GAT→CCA | D179→P189 | *GTT→GTA* | *V141→V153* | | | |
| | GTA→TTG | V181→L191 | CAA→AGA | Q142→R154 | | | |
| | ACC→AAG | T182→K192 | *TTG→CTA* | *L145→L157* | | | |
| | CCT→TCA | P183→S193 | TCT→GGC | S146→G158 | | | |
| | AAG→CCT | K184→P194 | *TCA→TCT* | *S174→S186* | | | |
| | TTT→ATT | F209→I219 | TTG→--- | L175→--- | | | |
| | ATG→GTC | M212→V222 | GTT→--- | V176→--- | | | |
| | ATC→TAC | I213→Y223 | CAA→GCT | Q178→A188 | | | |
| | AAT→--- | N214→--- | GAT→CCA | D179→P189 | | | |
| | TCA→--- | S215→--- | GTT→TTG | V181→L191 | | | |
| | ACA→CAA | T216→Q224 | ACT→AAG | T182→K192 | | | |
| | AGT→GAT | S217→D225 | CCA→TCA | P183→S193 | | | |
| | GAT→GAA | D218→E226 | AGA→CCT | R184→P194 | | | |
| | CAT→GCT | H219→A227 | AGA→GTC | R212→V222 | | | |
| | TTA→TTC | L220→F228 | ATT→TAC | I213→Y223 | | | |
| | TAC→CAT | Y221→H229 | GAT→--- | D214→--- | | | |
| | GAG→GAT | E238→D246 | TCT→--- | S215→--- | | | |
| | AAA→CAA | K252→Q260 | ACT→CAA | T216→Q224 | | | |
| | *TTA->CTG* | *L270->L278* | TCT→GAT | S217→D225 | | | |
| | CCT→TCA | P281→S289 | GAT→GAA | D218→E226 | | | |
| | CAA→AAA | Q292→K300 | GAT→GCT | D219→A227 | | | |
| | CTC→TGC | L313→C321 | TTG→TTC | L220→F228 | | | |
| | AGC→ACG | S314→T322 | GTT→CAT | V221→H229 | | | |
| | CTC→ATG | L315→M323 | *TTG→CTG* | *L270→L278* | | | |
| | ACT→AGT | T317→S325 | *GGT→GGG* | *G276→G284* | | | |
| | CAA→GCT | Q321→A329 | CCA→TCA | P281→S289 | | | |
| | GAA→GAT | E333→D341 | TTG→TGC | L313→C321 | | | |
| | AAA→CGA | K336→R344 | TCT→ACG | S314→T322 | | | |
| | TTG→ATT | L337→I345 | TTG→ATG | L315→M323 | | | |
| | GCT→ACA | A345→T353 | ACC→AGT | T317→S325 | | | |
| | GGA→CGG | G357→R365 | *GAC→GAT* | *D329→D337* | | | |
| | AAT→ATT | N369→I377 | AAG→CGA | K336→R344 | | | |
| | TCT→TAC | S377→Y385 | TTA→ATT | L337→I345 | | | |
| | ACA→AGA | T405→R413 | GGT→CGG | G357→R365 | | | |
| | AAT→GGT | N429→G437 | GAG→GAT | E484→D492 | | | |
| | GCA→TCT | A436→S444 | *ATA→ATC* | *I538→I546* | | | |
| | GAA→GAT | E484→D492 | | | | | |
| | ACC→CCA | T501→P509 | | | | | |
| | GAT→GAA | D536→E544 | | | | | |
| | *ATT->ATC* | *I538->I546* | | | | | |
| V314 | *TCG->TCT* | *S2S* | *TCA→TCT* | *S2S* | 997 | 996 | 101 |
| | TCT→ACT | S3T | TCT→ACT | S3T | | | |
| | GGA→CAA | G4Q | GGT→CAA | G4Q | | | |
| | GAA→GTC | E5V | GAA→GTC | E5V | | | |
| | ---→TCA | ---→S6 | ---→TCA | ---→S6 | | | |
| | ---→GCA | ---→A7 | ---→GCA | ---→A7 | | | |
| | ---→TCT | ---→S8 | ---→TCT | ---→S8 | | | |
| | ---→TCT | ---→S9 | ---→TCT | ---→S9 | | | |
| | ---→CTA | ---→L10 | ---→CTA | ---→L10 | | | |
| | ---→GCC | ---→A11 | ---→GCC | ---→A11 | | | |
| | ---→CAG | ---→Q12 | ---→CAG | ---→Q12 | | | |
| | ---→ATT | ---→I13 | ---→ATT | ---→I13 | | | |
| | ---→CCC | ---→P14 | ---→CCC | ---→P14 | | | |
| | ---→CAA | ---→Q15 | ---→CAA | ---→Q15 | | | |
| | ---→CCC | ---→P16 | ---→CCC | ---→P16 | | | |
| | ACA→AAA | T6→K17 | ACT→AAA | T6→K17 | | | |

TABLE 43-continued

CVS Variants

| Mutant | Nucleotide changes vs. wildtype | Amino acid changes vs. wildtype | Nucleotide changes vs. CVS V19 | Amino acid changes vs. CVS V19 | SEQ ID NO nt | SEQ ID NO aa | Valencene production % vs. V19 (Shake Flask) |
|---|---|---|---|---|---|---|---|
| | TTT→AAT | F7→N18 | TTT→AAT | F7→N18 | | | |
| | ACT→GTG | T10→V21 | *AGA→CGT* | *R8→R19* | | | |
| | GAT→AAC | D12→N23 | *CCA→CCT* | *P9→P20* | | | |
| | *CAT->CAC* | *H14->H25* | ACT→GTG | T10→V21 | | | |
| | *CCT->CCC* | *P15->P26* | *GCT→GCA* | *A11→A22* | | | |
| | AGT→AAC | S16→N27 | GAT→AAC | D12→N23 | | | |
| | TTA→ATT | L17→I28 | *CAT→CAC* | *H14→H25* | | | |
| | AGA→GGT | R19→G30 | *CCA→CCC* | *P15→P26* | | | |
| | AAC→GAC | N20→D31 | TCT→AAC | S16→N27 | | | |
| | CAT→CAA | H21→Q32 | TTG→ATT | L17→I28 | | | |
| | CTC→ATC | L23→I34 | AGA→GGT | R19→G30 | | | |
| | AAA→ACC | K24→T35 | AAT→GAC | N20→D31 | | | |
| | GGT→TAC | G25→Y36 | CAT→CAA | H21→Q32 | | | |
| | GCT→ACT | A26→T37 | TTG→ATC | L23→I34 | | | |
| | TCT→CCT | S27→P38 | CAA→ACC | Q24→T35 | | | |
| | GAT→GAA | D28→E39 | GGT→TAC | G25→Y36 | | | |
| | TTC→GAC | F29→D40 | GCA→ACT | A26→T37 | | | |
| | ACA→--- | T31→--- | TCA→CCT | S27→P38 | | | |
| | GAT→ACT | D33→T43 | GAT→GAA | D28→E39 | | | |
| | CAT→CGT | H34→R44 | TTT→GAC | F29→D40 | | | |
| | ACT→GCC | T35→A45 | ACT→--- | T31→--- | | | |
| | GCA→TGC | A36→C46 | GAT→ACT | D33→T43 | | | |
| | ACT→AAA | T37→K47 | CAT→CGT | H34→R44 | | | |
| | CAA→GAG | Q38→E48 | ACA→GCC | T35→A45 | | | |
| | *GAA->GAG* | *E39->E49* | GCT→TGC | A36→C46 | | | |
| | CGA→CAG | R40→Q50 | ACA→AAA | T37→K47 | | | |
| | CAC→ATT | H41→I51 | AAT→GAG | N38→E48 | | | |
| | ACA→TTA | T53→L63 | *GAA→GAG* | *E39→E49* | | | |
| | GAT→GCA | D54→A64 | AGA→CAG | R40→Q50 | | | |
| | GCT→ACC | A55→T65 | CAT→ATT | H41→I51 | | | |
| | GAA→GGA | E56→G66 | ACT→TTA | T53→L63 | | | |
| | GAT→AGG | D57→R67 | GAT→GCA | D54→A64 | | | |
| | *AAG->AAA* | *K58->K68* | GCA→ACC | A55→T65 | | | |
| | GTT→ATT | V60→I70 | GAA→GGA | E56→G66 | | | |
| | ATA→TTA | I86→L96 | GAT→AGG | D57→R67 | | | |
| | AAA→CAT | K88→H98 | CAA→AAA | Q58→K68 | | | |
| | TTA→ATT | L89→I99 | *GCT→GCA* | *A85→A95* | | | |
| | CCA→AAT | P91→N101 | ATT→TTA | I86→L96 | | | |
| | ATC→AGT | I92→S102 | CAA→CAT | Q88→H98 | | | |
| | TAT→TTT | Y93→F103 | TTG→ATT | L89→I99 | | | |
| | ATT→CAT | I94→H104 | CCA→AAT | P91→N101 | | | |
| | AGT→TGC | S96→C106 | ATT→AGT | I92→S102 | | | |
| | AGA→GAT | R98→D108 | CAT→TTT | H93→F103 | | | |
| | GCT→ATG | A99→M109 | ATT→CAT | I94→H104 | | | |
| | ---→GGT | ---→G111 | *GAT→GAC* | *D95→D105* | | | |
| | ---→GAT | ---→D112 | TCT→TGC | S96→C106 | | | |
| | AAG→CAA | K125→Q137 | GAT→AAT | D97→N107 | | | |
| | AAG→CAA | K173→Q185 | AAA→GAT | K98→D108 | | | |
| | *TCA->TCT* | *S174->S186* | GCT→ATG | A99→M109 | | | |
| | TTG→--- | L175→--- | ---→GGT | ---→G111 | | | |
| | GTA→--- | V176→--- | ---→GAT | ---→D112 | | | |
| | CAG→GCT | Q178→A188 | *TCA→TCT* | *S174→S186* | | | |
| | GAT→CCA | D179→P189 | TTG→--- | L175→--186 | | | |
| | GTA→TTG | V181→L191 | GTT→--- | V176→--186 | | | |
| | ACC→AAG | T182→K192 | CAA→GCT | Q178→A188 | | | |
| | CCT→TCA | P183→S193 | GAT→CCA | D179→P189 | | | |
| | AAG→CCT | K184→P194 | GTT→TTG | V181→L191 | | | |
| | TTT→ATT | F209→I219 | ACT→AAG | T182→K192 | | | |
| | ATG→GTC | M212→V222 | CCA→TCA | P183→S193 | | | |
| | ATC→TAC | I213→Y223 | AGA→CCT | R184→P194 | | | |
| | AAT→--- | N214→--- | AGA→GTC | R212→V222 | | | |
| | TCA→--- | S215→--- | ATT→TAC | I213→Y223 | | | |
| | ACA→CAA | T216→Q224 | GAT→--- | D214→--- | | | |
| | AGT→GAT | S217→D225 | TCT→--- | S215→--- | | | |
| | GAT→GAA | D218→E226 | ACT→CAA | T216→Q224 | | | |
| | CAT→GCT | H219→A227 | TCT→GAT | S217→D225 | | | |
| | TTA→TTC | L220→F228 | GAT→GAA | D218→E226 | | | |
| | TAC→CAT | Y221→H229 | GAT→GCT | D219→A227 | | | |
| | GAG→GAT | E238→D246 | TTG→TTC | L220→F228 | | | |
| | AAA→CAA | K252→Q260 | GTT→CAT | V221→H229 | | | |
| | *TTA->CTG* | *L270->L278* | *TTG→CTG* | *L270→L278* | | | |

TABLE 43-continued

CVS Variants

| Mutant | Nucleotide changes vs. wildtype | Amino acid changes vs. wildtype | Nucleotide changes vs. CVS V19 | Amino acid changes vs. CVS V19 | SEQ ID NO nt | SEQ ID NO aa | Valencene production % vs. V19 (Shake Flask) |
|---|---|---|---|---|---|---|---|
| | CCT→TCA | P281→S289 | *GGT→GGG* | *G276→G284* | | | |
| | CAA→AAA | Q292→K300 | CCA→TCA | P281→S289 | | | |
| | CTC→TGC | L313→C321 | TTG→TGC | L313→C321 | | | |
| | AGC→ACG | S314→T322 | TCT→ACG | S314→T322 | | | |
| | CTC→ATG | L315→M323 | TTG→ATG | L315→M323 | | | |
| | ACT→AGT | T317→S325 | ACC→AGT | T317→S325 | | | |
| | CAA→GCT | Q321→A329 | *GAC→GAT* | *D329→D337* | | | |
| | GAA→GAT | E333→D341 | AAG→CGA | K336→R344 | | | |
| | AAA→CGA | K336→R344 | TTA→ATT | L337→I345 | | | |
| | TTG→ATT | L337→I345 | GGT→CGG | G357→R365 | | | |
| | GCT→ACA | A345→T353 | GAG→GAT | E484→D492 | | | |
| | GGA→CGG | G357→R365 | *ATA→ATC* | *I538→I546* | | | |
| | AAT→ATT | N369→I377 | | | | | |
| | TCT→TAC | S377→Y385 | | | | | |
| | ACA→AGA | T405→R413 | | | | | |
| | AAT→GGT | N429→G437 | | | | | |
| | GCA→TCT | A436→S444 | | | | | |
| | GAA→GAT | E484→D492 | | | | | |
| | ACC→CCA | T501→P509 | | | | | |
| | GAT→GAA | D536→E544 | | | | | |
| | *ATT->ATC* | *I538->I546* | | | | | |
| V315 | *TCG->TCT* | *S2S* | *TCA→TCT* | *S2S* | 999 | 998 | 88.8 |
| | TCT→ACT | S3T | TCT→ACT | S3T | | | |
| | GGA→CAA | G4Q | GGT→CAA | G4Q | | | |
| | GAA→GTC | E5V | GAA→GTC | E5V | | | |
| | ---→TCA | ---→S6 | ---→TCA | ---→S6 | | | |
| | ---→GCA | ---→A7 | ---→GCA | ---→A7 | | | |
| | ---→TCT | ---→S8 | ---→TCT | ---→S8 | | | |
| | ---→TCT | ---→S9 | ---→TCT | ---→S9 | | | |
| | ---→CTA | ---→L10 | ---→CTA | ---→L10 | | | |
| | ---→GCC | ---→A11 | ---→GCC | ---→A11 | | | |
| | ---→CAG | ---→Q12 | ---→CAG | ---→Q12 | | | |
| | ---→ATT | ---→I13 | ---→ATT | ---→I13 | | | |
| | ---→CCC | ---→P14 | ---→CCC | ---→P14 | | | |
| | ---→CAA | ---→Q15 | ---→CAA | ---→Q15 | | | |
| | ---→CCC | ---→P16 | ---→CCC | ---→P16 | | | |
| | ACA→AAA | T6→K17 | ACT→AAA | T6→K17 | | | |
| | TTT→AAT | F7→N18 | TTT→AAT | F7→N18 | | | |
| | ACT→GTG | T10→V21 | *AGA→CGT* | *R8→R19* | | | |
| | GAT→AAC | D12→N23 | *CCA→CCT* | *P9→P20* | | | |
| | *CAT->CAC* | *H14->H25* | ACT→GTG | T10→V21 | | | |
| | *CCT->CCC* | *P15->P26* | *GCT→GCA* | *A11→A22* | | | |
| | AGT→AAC | S16→N27 | GAT→AAC | D12→N23 | | | |
| | TTA→ATT | L17→I28 | *CAT→CAC* | *H14→H25* | | | |
| | AGA→GGT | R19→G30 | *CCA→CCC* | *P15→P26* | | | |
| | AAC→GAC | N20→D31 | TCT→AAC | S16→N27 | | | |
| | CAT→CAA | H21→Q32 | TTG→ATT | L17→I28 | | | |
| | CTC→ATC | L23→I34 | AGA→GGT | R19→G30 | | | |
| | AAA→ACC | K24→T35 | AAT→GAC | N20→D31 | | | |
| | GGT→TAC | G25→Y36 | CAT→CAA | H21→Q32 | | | |
| | GCT→ACT | A26→T37 | TTG→ATC | L23→I34 | | | |
| | TCT→CCT | S27→P38 | CAA→ACC | Q24→T35 | | | |
| | GAT→GAA | D28→E39 | GGT→TAC | G25→Y36 | | | |
| | TTC→GAC | F29→D40 | GCA→ACT | A26→T37 | | | |
| | ACA→--- | T31→--- | TCA→CCT | S27→P38 | | | |
| | GAT→ACT | D33→T43 | GAT→GAA | D28→E39 | | | |
| | CAT→CGT | H34→R44 | TTT→GAC | F29→D40 | | | |
| | ACT→GCC | T35→A45 | ACT→--- | T31→--- | | | |
| | GCA→TGC | A36→C46 | GAT→ACT | D33→T43 | | | |
| | ACT→AAA | T37→K47 | CAT→CGT | H34→R44 | | | |
| | CAA→GAG | Q38→E48 | ACA→GCC | T35→A45 | | | |
| | *GAA->GAG* | *E39->E49* | GCT→TGC | A36→C46 | | | |
| | CGA→CAG | R40→Q50 | ACA→AAA | T37→K47 | | | |
| | CAC→ATT | H41→I51 | AAT→GAG | N38→E48 | | | |
| | ACA→TTA | T53→L63 | *GAA→GAG* | *E39→E49* | | | |
| | GAT→GCA | D54→A64 | AGA→CAG | R40→Q50 | | | |
| | GCT→ACC | A55→T65 | CAT→ATT | H41→I51 | | | |
| | GAA→GGA | E56→G66 | ACT→TTA | T53→L63 | | | |
| | GAT→AGG | D57→R67 | GAT→GCA | D54→A64 | | | |
| | *AAG->AAA* | *K58->K68* | GCA→ACC | A55→T65 | | | |

TABLE 43-continued

CVS Variants

| Mutant | Nucleotide changes vs. wildtype | Amino acid changes vs. wildtype | Nucleotide changes vs. CVS V19 | Amino acid changes vs. CVS V19 | SEQ ID NO nt | SEQ ID NO aa | Valencene production % vs. V19 (Shake Flask) |
|---|---|---|---|---|---|---|---|
| | GTT→ATT | V60→I70 | GAA→GGA | E56→G66 | | | |
| | GCA→ATG | A85→M95 | GAT→AGG | D57→R67 | | | |
| | ATA→TTG | I86→L96 | CAA→AAA | Q58→K68 | | | |
| | CAA→GAT | Q87→D97 | GCT→ATG | A85→M95 | | | |
| | AAA→CAC | K88→H98 | ATT→TTG | I86→L96 | | | |
| | TTA→ATT | L89→I99 | CAA→GAT | Q87→D97 | | | |
| | TGT→TAC | C90→Y100 | CAA→CAC | Q88→H98 | | | |
| | ---→AGA | ---→R101 | TTG→ATT | L89→I99 | | | |
| | ---→GCT | ---→A102 | TGT→TAC | C90→Y100 | | | |
| | ---→GAT | ---→D103 | ---→AGA | ---→R101 | | | |
| | *CCA->CCT* | *P91->P104* | ---→GCT | ---→A102 | | | |
| | ATC→TAT | I92→Y105 | ---→GAT | ---→D103 | | | |
| | TAT→TTT | Y93→F106 | *CCA→CCT* | *P91→P104* | | | |
| | ATT→GAG | I94→E107 | ATT→TAT | I92→Y105 | | | |
| | GAC→GCT | D95→A108 | CAT→TTT | H93→F106 | | | |
| | AGT→CAT | S96→H109 | ATT→GAG | I94→E107 | | | |
| | AAT→GAA | N97→E110 | GAT→GCT | D95→A108 | | | |
| | AGA→TAC | R98→Y111 | TCT→CAT | S96→H109 | | | |
| | GCT→AAT | A99→N112 | GAT→GAA | D97→E110 | | | |
| | AAG→CAA | K125→Q138 | AAA→TAC | K98→Y111 | | | |
| | AAG→CAA | K173→Q186 | GCT→AAT | A99→N112 | | | |
| | *TCA->TCT* | *S174->S187* | *TCA→TCT* | *S174→S187* | | | |
| | TTG→--- | L175→--- | TTG→--- | L175→--- | | | |
| | GTA→--- | V176→--- | GTT→--- | V176→--- | | | |
| | CAG→GCT | Q178→A189 | CAA→GCT | Q178→A189 | | | |
| | GAT→CCA | D179→P190 | GAT→CCA | D179→P190 | | | |
| | GTA→TTG | V181→L192 | GTT→TTG | V181→L192 | | | |
| | ACC→AAG | T182→K193 | ACT→AAG | T182→K193 | | | |
| | CCT→TCA | P183→S194 | CCA→TCA | P183→S194 | | | |
| | AAG→CCT | K184→P195 | AGA→CCT | R184→P195 | | | |
| | TTT→ATT | F209→I220 | AGA→GTC | R212→V223 | | | |
| | ATG→GTC | M212→V223 | ATT→TAC | I213→Y224 | | | |
| | ATC→TAC | I213→Y224 | GAT→--- | D214→--- | | | |
| | AAT→--- | N214→--- | TCT→--- | S215→--- | | | |
| | TCA→--- | S215→--- | ACT→CAA | T216→Q225 | | | |
| | ACA→CAA | T216→Q225 | TCT→GAT | S217→D226 | | | |
| | AGT→GAT | S217→D226 | GAT→GAA | D218→E227 | | | |
| | GAT→GAA | D218→E227 | GAT→GCT | D219→A228 | | | |
| | CAT→GCT | H219→A228 | TTG→TTC | L220→F229 | | | |
| | TTA→TTC | L220→F229 | GTT→CAT | V221→H230 | | | |
| | TAC→CAT | Y221→H230 | *TTG→CTG* | *L270→L279* | | | |
| | GAG→GAT | E238→D247 | *GGT→GGG* | *G276→G285* | | | |
| | AAA→CAA | K252→Q261 | CCA→TCA | P281→S290 | | | |
| | *TTA->CTG* | *L270->L279* | TTG→TGC | L313→C322 | | | |
| | CCT→TCA | P281→S290 | TCT→ACG | S314→T323 | | | |
| | CAA→AAA | Q292→K301 | TTG→ATG | L315→M324 | | | |
| | CTC→TGC | L313→C322 | ACC→AGT | T317→S326 | | | |
| | AGC→ACG | S314→T323 | *GAC→GAT* | *D329→D338* | | | |
| | CTC→ATG | L315→M324 | AAG→CGA | K336→R345 | | | |
| | ACT→AGT | T317→S326 | TTA→ATT | L337→I346 | | | |
| | CAA→GCT | Q321→A330 | GGT→CGG | G357→R366 | | | |
| | GAA→GAT | E333→D342 | *TTG→CTG* | *L399→L408* | | | |
| | AAA→CGA | K336→R345 | GAG→GAT | E484→D493 | | | |
| | TTG→ATT | L337→I346 | *ATA→ATC* | *I538→I547* | | | |
| | GCT→ACA | A345→T354 | | | | | |
| | GGA→CGG | G357→R366 | | | | | |
| | AAT→ATT | N369→I378 | | | | | |
| | TCT→TAC | S377→Y386 | | | | | |
| | *CTA->CTG* | *L399->L408* | | | | | |
| | ACA→AGA | T405→R414 | | | | | |
| | AAT→GGT | N429→G438 | | | | | |
| | GCA→TCT | A436→S445 | | | | | |
| | GAA→GAT | E484→D493 | | | | | |
| | ACC→CCA | T501→P510 | | | | | |
| | GAT→GAA | D536→E545 | | | | | |
| | *ATT->ATC* | *I538->I547* | | | | | |

Since modifications will be apparent to those of skill in this art, it is intended that this invention be limited only by the scope of the appended claims.

SEQUENCE LISTING (1007 sequences)

SEQ ID NO: 1 - DNA, 1647 bp, Citrus sinensis
  Citrus valencene synthase
atgtcgtctggagaaacatttcgtcctactgcagatttccatcctagtttatggagaaaccatttcctcaaaggtgcttctgatttcaagacagttgatcatactgcaactcaagaacgacacgaggcactgaaagaagaggtaaggagaatgataacagatgctgaagataagcctgttcagaagttacgcttgattgatgaagtacaacgcctgggggtggcttatcactttgagaaagaaatagaagatgcaatacaaaaattatgtccaatctatattgacagtaatagagctgatctccacaccgtttcccttcattttcgattgcttaggcagcaaggaatcaagatttcatgtgatgtgtttgagaagttcaaagatgatgagggtagattcaagtcatcgttgataaacgatgttcaagggatgttaagtttgtacgaggcagcatacatggcagttcgcggagaacatatattagatgaagccattgctttcactaccactcacctgaagtcattggtagctcaggatcatgtaacccctaagcttgcggaacagataaatcatgctttataccgtcctcttcgtaaaaccctaccaagattagaggcgaggtattttatgtccatgatcaattcaacaagtgatcatttatacaataaaactctgctgaattttgcaaagttagattttaacatattgctagagctgcacaaggaggaactcaatgaattaacaaagtggtggaaagatttagacttcactacaaaactaccttatgcaagagacagattagtggagttatatttttgggatttagggacatacttcgagcctcaatatgcatttgggagaaagataatgacccaattaaattacatattatccatcatagatgatacttatgatgcgtatggtacacttgaagaactcagcctctttactgaagcagttcaaagatggaatattgaggccgtagatatgcttccagaatacatgaaattgatttacaggacactcttagatgcttttaatgaaattgaggaagatatggccaagcaaggaagatcacactgcgtacgttatgcaaaagaggagaatcaaaaagtaattggagcatactctgttcaagccaaatggttcagtgaaggttacgttccaacaattgaggagtatatgcctattgcactaacaagttgtgcttacacattcgtcataacaaattccttccttggcatgggtgattttgcaactaaagaggtttttgaatggatctccaataaccctaaggttgtaaaagcagcatcagttatctgcagactcatggatgacatgcaaggtcatgagtttgagcagaagagaggacatgttgcgtcagctattgaatgttacacgaagcagcatggtgtctctaaggaagaggcaattaaaatgtttgaagaagaagttgcaaatgcatggaaagatattaacgaggagttgatgatgaagccaaccgtcgttgcccgaccactgctcgggacgattcttaatcttgctcgtgcaattgattttatttacaaagaggacgacggctatacgcattcttacctaattaaagatcaaattgcttctgtgctaggagaccacgttccattttga

SEQ ID NO: 2 - protein, 548 aa, Citrus sinensis
  Citrus Valencene Synthase
MSSGETFRPTADFHPSLWRNHFLKGASDFKTVDHTATQERHEALKEEVRRMITDAEDKPVQKLRLIDEVQRLGVAYHFEKEIEDAIQKLCPIYIDSNRADLHTVSLHFRLLRQQGIKISCDVFEKFKDDEGRFKSSLINDVQGMLSLYEAAYMAVRGEHILDEAIAFTTTHLKSLVAQDHVTPKLAEQINHALYRPLRKTLPRLEARYFMSMINSTSDHLYNKTLLNFAKLDFNILLELHKEELNELTKWWKDLDFTTKLPYARDRLVELYFWDLGTYFEPQYAFGRKIMTQLNYILSIIDDTYDAYGTLEELSLFTEAVQRWNIEAVDMLPEYMKLIYRTLLDAFNEIEEDMAKQGRSHCVRYAKEENQKVIGAYSVQAKWFSEGYVPTIEEYMPIALTSCAYTFVITNSFLGMGDFATKEVFEWISNNPKVVKAASVICRLMDDMQGHEFEQKRGHVASAIECYTKQHGVSKEEAIKMFEEEVANAWKDINEELMMKPTVVARPLLGTILNLARAIDFIYKEDDGYTHSYLIKDQIASVLGDHVPF

SEQ ID NO: 3 - protein, 548 aa, Artificial Sequence
  CVS V18
MSSGETFRPTADFHPSLWRNHFLAGASDFKTVDHTATAERHEALKEEVRRMITDAEDAPIQKLRLIDEVQRLGVAYHFEKEIEDAIQALCPIHIDSDKADLHTVSLHFRLLRQQGIKISCDVFEAFKDDEGRFKSSLINDVQGMLSLYEAAYMAVRGEHILDEAIAFTTTHLASLVAQDHVTPRLAEQINHALYRPLRKTLPRLEARYIMSRIDSTSDDLVNKTLLNFAKLDFNILLDLHKEELNELTKWWADLDFTTKLPYARDRLVELYFWDLGTYFEPQYAFGRKIMTKLNYILSIIDDTYDAYGTLEELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 4 - protein, 548 aa, Artificial Sequence
  CVS V19
MSSGETFRPTADFHPSLWRNHFLQGASDFKTVDHTATNERHEALKEEVRRMITDAEDQPIQKLRLIDEVQRLGVAYHFEKEIEDAIQQLCPIHIDSDKADLHTVSLHFRLLRQQGIKISCDVFEQFKDDEGRFKSSLINDVQGMLSLYEAAYMAVRGEHILDEAIAFTTTHLQSLVAQDHVTPRLAEQINHALYRPLRKTLPRLEARYIMSRIDSTSDDLVNKTLLNFAKLDFNILLDLHKEELNELTKWWQDLDFTTKLPYARDRLVELYFWDLGTYFEPQYAFGRKIMTKLNYILSIIDDTYDAYGTLEELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 5 - protein, 547 aa, Artificial Sequence
  CVS mutant V75 and V76
MSSGETFRPTADFHPSLWRNHFLQGASDFKTVDHTATNERHEALKEEVRRMITDAEDQPIQKLRLIDEVQRLGVAYHFEKEIEDAIQQLCPIHIDSDKADLHTVSLHFRLLRQQGIKISCDVFEQFKDDEGRFKSSLINDVQGMLSLYEAAYMAVRGEHILDEAIAFTTTHLQSLVAQDHVTPRLAEQINHALYRPLRKTLPRLEARYIMSRIDSTSDDLVNKTLLNFAKLDFNILLDLHKEELNELTKWWQDLDFTTKLPYARDRLVELYFWDLGTYFESQYAFGRKIMTKLNYILSIIDDTYDAYGTLEECTMFSEAVARWNIEAVDMLPDYMRIIYRTLLDTFNEIEEDMAKQRRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVP

SEQ ID NO: 6 - protein, 548 aa, Artificial Sequence
  CVS mutant V1
MSSGETFRPTADFHPSLWRNHFLKGASDFKTVDHTATQERHEALKEEVRRMITDAEDKPVQKLRLIDEVQRLGVAYHFEKEIEDAIQKLCPIYIDSNRADLHTVSLHFRLLRQQGIKISCDVFEKFKDDEGRFKSSLINDVQGMLSLYEAAYMAVRGEHILDEAIAFTTTHLKSLVAQDHVTPKLAEQINHALYRPLRKTLPRLEARYFMSMIDSTSDHLYNKTLLNFAKLDFNILLELHKEELNELTKWWKDLDFTTKLPYARDRLVELYFWDLGTYFEPQYAFGRKIMTQLNYILSIIDDTYDAYGTLEELSLFTEAVQRWNIEAVDMLPEYMKLIYRTLLDAFNEIEEDMAKQGRSHCVRYAKEENQKVIGAYSVQAKWFSEGYVPTIEEYMPIALTSCAYTFVITNSFLGMGDFATKEVFEWISNNPKVVKAASVICRLMDDMQGHEFEQKRGHVASAIECYTKQHGVYKEEAIKMFEEEVANAWKDINEELMMKPTVVARPLLGTILNLARAIDFIYKEDDGYTHSYLIKDQIASVLGDHVPF

SEQ ID NO: 7 - protein, 548 aa, Artificial Sequence
  CVS mutant V2
MSSGETFRPTADFHPSLWRNHFLKGASDFKTVDHTATQERHEALKEEVRRMITDAEDKPVQKLRLIDEVQRLGVAYHFEKEIEDAIQKLCPIYIDSNRADLHTVSLHFRLLRQQGIKISCDVFEKFKDDEGRFKSSLINDVQGMLSLYEAAYMAVRGEHILDEAIAFTTTHLKSLVAQDHVTPKLAEQINHALYRPLRKTLPRLEARYFMSMINSTSDHLYNKTLLNFAKLDFNILLELHKEELNELTKWWKDLDFTTKLPYARDRLVELYFWDLGTYFEPQYAFGRKIMTQLNYILSIIDDTYDAYGTLEELSLFTEAVQRWNIEAVDMLPEYMKLIYRTLLDAFNEIEEDMAKQGRSHCVRYAKEENQKVIGAYSVQAKWFSEGYVPTIEEYMPIALTSCAYRFVITNSFLGMGDFATKEVFEWISNNPKVVKAASVICRLMDDMQGHEFEQKRGHVASAIECYTKQHGVSKEEAIKMFEEEVANAWKDINEELMMKPTVVARPLLGTILNLARAIDFIYKEDDGYTHSYLIKDQIASVLGDHVPF

SEQ ID NO: 8 - protein, 548 aa, Artificial Sequence
  CVS mutant V3
MSSGETFRPTADFHPSLWRNHFLKGASDFKTVDHTATQERHEALKEEVRRMITDAEDKPVQKLRLIDEVQRLGVAYHFEKEIEDAIQKLCPIYIDSNRADLHTVSLHFRLLRQQGIKISCDVFEKFKDDEGRFKSSLINDVQGMLSLYEAAYMAVRGEHILDEAIAFTTTHLKSLVAQDHVTPKLAEQINHALYRPLRKTLPRLEARYFMSMINSTSDHLYNKTLLNFAKLDFNILLELHKEELNELTKWWKDLDFTTKLPYARDRLVELYFWDLGTYFEPQYAFGRKIMTQLNYILSIIDDTYDAYGTLEELSLFTEAVQRWNIEAVDMLPEYMKLIYRTLLDVFNEIEEDMAKQGRSHCVRYAKEENQKVIGAYSVQAKWFSEGYVPTIEEYMPIALTSCAYTFVITNSFLGMGDFATKEVFEWISNNPKVVKAASVICRLMDDMQGHEFEQKRGHVASAIECYTKQHGVSKEEAIKMFEEEVANAWKDINEELMMKPTVVARPLLGTILNLARAIDFIYKEDDGYTHSYLIKEQIASVLGDHVPF

SEQ ID NO: 9 - protein, 548 aa, Artificial Sequence
  CVS mutant V4
MSSGETFRPTADFHPSLWRNHFLKGASDFKTVDHTATQERHEALKEEVRRMITDAEDKPVQKLRLIDEVQRLGVAYHFEKEIEDAIQKLCPIYIDSNRADLHTVSLHFRLLRQQGIKISCDVFEKFKDDEGRFKSSLINDVQGMLSLYEAAYMAVRGEHILDEAIAFTTTHLKSLVAQDHVTPKLAEQINHALYRPLRKTLPRLEARYFMSMINSTSDHLCNKTLLNFAKLDFNILLELHKEELNELTKWWKDLDFTTKLPYARDRLVELYFWDLGTYFEPQYAFGRKIMTQLNYILSIIDDTYDAYGTLEELSLFTEAVQRWNIEAVDMLPEYMKLIYRTLLDAFNEIEEDMAKQGRSHCVRYAKEENQKVIGAYSVQAKWFSEGYVPTIEEYMPIALTSCAYTFVITNSFLGMGDFATKEVFEWISNNPKVVKAASVICRLMDDMQGHEFEQKRGHVASAIECYTKQHGVSKEEAIKMFEEEVANAWKDINEELMMKPTVVARPLLGTILNLARAIDFIYKEDDGYTHSYLIKDQIASVLGDHVPF

SEQ ID NO: 10 - protein, 548 aa, Artificial Sequence
  CVS mutant V5
MSSGETFRPTADFHPSLWRNHFLKGASDFKTVDHTATQERHEALKEEVRRMITDAEDKPVQKLRLIDEVQRLGVAYHFEKEIEDAIQKLCPIYIDSNRADLHTVSLHFRLLRQQGIKISCDVFEKFKDDEGRFKSSLINDVQGMLSLYEAAYMAVRGEHILDEAIAFTTTHLKSLVAQDHVTPKLAEQINHALYRPLRKTLPRLEARYFMSMINSTSDHLYNKTLLNFAKLDFNILLDLHKEELNELTKWWKDLDFTTKLPYARDRLVELYFWDLGTYFEPQYAFGRKIMTQLNYILSIIDDTYDAYGTLEELSLFTEAVQRWNIEAVDMLPEYMKLIYRTLLDAFNEIEEDMAKQGRSHCVRYAKEENQKVIGAYSVQAKWFSEGYVPTIEEYMPIALTSCAYTFVITNSFLGMGDFATKEVFEWISNNPKVVKAASVICRLMDDMQGHEFEQKRGHVASAIECYTKQHGVSKEEAIKMFEEEVANAWKDINEELMMKPTVVARPLLGTILNLARAIDFIYKEDDGYTHSYLIKDQIASVLGDHVPF

SEQ ID NO: 11 - protein, 548 aa, Artificial Sequence
  CVS mutant V6
MSSGETFRPTADFHPSLWRNHFLKGASDFKTVDHTATQERHEALKEEVRRMITDAEDKPVQKLRLIDEVQRLGVAYHFEKEIEDAIQKLCPIYIDSNRADLHTVSLHFRLLRQQGIKISCDVFEKFKDDEGRFKSSLINDVQGMLSLYEAAYMAVRGEHILDEAIAFTTTHLKSLVAQDHVTPKLAEQINHALYRPLRKTLPRLEARYIMSMINSTSDHLYNKTLLNFAKLDFNILLELHKEELNELTKWWKDLDFTTKLPYARDRLVELYFWDLGTYFEPQYAFGRKIMTQLNYILSIIDDTYDAYGTLEELSLFTEAVQRWNIEAVDMLPEYMKLIYRTLLDAFNEIEEDMAKQGRSHCVRYAKEENQKVIGAYSVQAKWFSEGYVPTIEEYMPIALTSCAYTFVITNSFLGMGDFATKEVFEWISNNPKVVKAASVICRLMDDMQGHEFEQKRGHVASAIECYTKQHGVSKEEAIKMFEEEVANAWKDINEELMMKPTVVARPLLGTILNLARAIDFIYKEDDGYTHSYLIKDQIASVLGDHVPF

SEQ ID NO: 12 - protein, 548 aa, Artificial Sequence
  CVS mutant V7
MSSGETFRPTADFHPSLWRNHFLKGASDFKTVDHTATQERHEALKEEVRRMITDAEDKPVQKLRLIDEVQRLGVAYHFEKEIEDAIQKLCPIYIDSDRADLHTVSLHFRLLRQQGIKISCDVFEKFKDDEGRFKSSLINDVQGMLSLYEAAYMAVRGEHILDEAIAFTTTHLKSLVAQDHVTPKLAEQINHALYRPLRKTLPRLEARYFMSMINSTSDHLYNKTLLNFAKLDFNILLELHKEELNELTKWWKDLDFTTKLPYARDRLVELYFWDLGTYFEPQYAFGRKIMTQLNYILSIIDDTYDAYGTLEELSLFTEAVQRWNIEAVDMLPEYMKLIYRTLLDAFNEIEEDMAKQGRSHCVRYAKEENQKVIGAYSVQAKWFSEGYVPTIEEYMPIALTSCAYTFVITNSFLGMGDFATKEVFEWISNNPKVVKAASVICRLMDDMQGHEFEQKRGHVASAIECYTKQHGVSKEEAIKMFEEEVANAWKDINEELMMKPTVVARPLLGTILNLARAIDFIYKEDDGYTHSYLIKDQIASVLGDHVPF

SEQ ID NO: 13 - protein, 548 aa, Artificial Sequence
  CVS mutant V8
MSSGETFRPTADFHPSLWRNHFLKGASDFKTVDHTATQERHEALKEEVRRMITDAEDKPVQKLRLIDEVQRLGVAYHFEKEIEDAIQKLCPIYIDSNRADLHTVSLHFRLLRQQGIKISCDVFEKFKDDEGRFKSSLINDVQGMLSLYEAAYMAVRGEHILDEAIAFTTTHLKSLVAQDHVTPKLAEQINHALYRPLRKTLPRLEARYFMSMINSTSDHLYNKTLLNFAKLDFNILLELHKEELNELTKWWKDLDFTTKLPYARDRLVELYFWDLGTYFEPQYAFGRKIMTQLNYILSIIDDTYDAYGTLEELSLFTEAVQRWNIEAVDMLPDYMKLIYRTLLDAFNEIEEDMAKQGRSHCVRYAKEEIQKVIGAYSVQAKWFSEGYVPTIEEYMPIALTSCAYTFVITNSFLGMGDFATKEVFEWISNNPKVVKAASVICRLMDDMQGHEFEQKRGHVASAIECYTKQHGVSKEEAIKMFEEEVANAWKDINEELMMKPTVVARPLLGTILNLARAIDFIYKEDDGYTHSYLIKDQIASVLGDHVPF

SEQ ID NO: 14 - protein, 548 aa, Artificial Sequence
  CVS mutant V9
MSSGETFRPTADFHPSLWRNHFLKGASDFKTVDHTATQERHEALKEEVRRMITDAEDKPVQKLRLIDEVQRLGVAYHFEKEIEDAIQKLCPIYIDSNRADLHTVSLHFRLLRQQGIKISCDVFEKFKDDEGRFKSSLINDVQGMLSLYEAAYMAVRGEHILDEAIAFTTTHLKSLVAQDHVTPKLAEQINHALYRPLRKTLPRLEARYFMSMIDSTSDHLYNKTLLNFAKLDFNILLELHKEELNELTKWWKDLDFTTKLPYARDRLVELYFWDLGTYFEPQYAFGRKIMTQLNYILSIIDDTYDAYGTLEELSLFTEAVQRWNIEAVDMLPEYMKLIYRTLLDAFNEIEEDMAKQGRSHCVRYAKEENQKVIGAYSVQAKWFSEGYVPTIEEYMPIALTSCAYRFVITNSFLGMGDFATKEVFEWISNNPKVVKAASVICRLMDDMQGHEFEQKRGHVASAIECYTKQHGVSKEEAIKMFEEEVANAWKDINEELMMKPTVVARPLLGTILNLARAIDFIYKEDDGYTHSYLIKDQIASVLGDHVPF

SEQ ID NO: 15 - protein, 548 aa, Artificial Sequence
  CVS mutant V10
MSSGETFRPTADFHPSLWRNHFLKGASDFKTVDHTATQERHEALKEEVRRMITDAEDKPVQKLRLIDEVQRLGVAYHFEKEIEDAIQKLCPIYIDSNRADLHTVSLHFRLLRQQGIKISCDVFEKFKDDEGRFKSSLINDVQGMLSLYEAAYMAVRGEHILDEAIAFTTTHLKSLVAQDHVTPKLAEQINHALYRPLRKTLPRLEARYFMSMIDSTSDHLYNKTLLNFAKLDFNILLELHKEELNELTKWWKDLDFTTKLPYARDRLVELYFWDLGTYFEPQYAFGRKIMTQLNYILSIIDDTYDAYGTLEELSLFTEAVQRWNIEAVDMLPEYMKLIYRTLLDVFNEIEEDMAKQGRSHCVRYAKEENQKVIGAYSVQAKWFSEGYVPTIEEYMPIALTSCAYRFVITNSFLGMGDFATKEVFEWISNNPKVVKAASVICRLMDDMQGHEFEQKRGHVASAIECYTKQHGVSKEEAIKMFEEEVANAWKDINEELMMKPTVVARPLLGTILNLARAIDFIYKEDDGYTHSYLIKEQIASVLGDHVPF

SEQ ID NO: 16 - protein, 548 aa, Artificial Sequence
  CVS mutant V12
MSSGETFRPTADFHPSLWRNHFLKGASDFKTVDHTATQERHEALKEEVRRMITDAEDKPIQKLRLIDEVQRLGVAYHFEKEIEDAIQKLCPIYIDSNRADLHTVSLHFRLLRQQGIKISCDVFEKFKDDEGRFKSSLINDVQGMLSLYEAAYMAVRGEHILDEAIAFTTTHLKSLVAQDHVTPKLAEQINHALYRPLRKTLPRLEARYFMSMIDSTSDHLYNKTLLNFAKLDFNILLELHKEELNELTKWWKDLDFTTKLPYARDRLVELYFWDLGTYFEPQYAFGRKIMTQLNYILSIIDDTYDAYGTLEELSLFTEAVQRWNIEAVDMLPEYMKLIYRTLLDTFNEIEEDMAKQGRSHCVRYAKEENQKVIGAYSVQAKWFSEGYVPTIEEYMPIALTSCAYRFVITNSFLGMGDFATKEVFEWISNNPKVVKAASVICRLMDDMQGHEFEQKRGHVASAIECYTKQHGVSKEEAIKMFEEEVANAWKDINEELMMKPTVVARPLLGTILNLARAIDFIYKEDDGYTHSYLIKDQIASVLGDHVPF

SEQ ID NO: 17 - protein, 548 aa, Artificial Sequence
  CVS mutant V13
MSSGETFRPTADFHPSLWRNHFLKGASDFKTVDHTATQERHEALKEEVRRMITDAEDKPVQKLRLIDEVQRLGVAYHFEKEIEDAIQKLCPIYIDSNRADLHTVSLHFRLLRQQGIKISCDVFEKFKDDEGRFKSSLINDVQGMLSLYEAAYMAVRGEHILDEAIAFTTTHLKSLVAQDHVTPKLAEQINHALYRPLRKTLPRLEARYFMSMIDSTSDHLYNKTLLNFAKLDFNILLELHKEELNELTKWWKDLDFTTKLPYARDRLVELYFWDLGTYFEPQYAFGRKIMTQLNYILSIIDDTYDAYGTLEELSLFTEAVQRWNIEAVDMLPEYMKLIYRTLLDAFNEIEEDMAKQGRSHCVRYAKEENQKVIGAYSVQAKWFSEGYVPTIEEYMPIALTSCAYRFVITNSFLGMGDFATKEVFEWISSNPKVVKAASVICRLMDDMQGHEFEQKRGHVASAIECYTKQHGVSKEEAIKMFEEEVANAWKDINEELMMKPTVVARPLLGTILNLARAIDFIYKEDDGYTHSYLIKDQIASVLGDHVPF

SEQ ID NO: 18 - protein, 548 aa, Artificial Sequence
  CVS mutant V14
MSSGETFRPTADFHPSLWRNHFLKGASDFKTVDHTATQERHEALKEEVRRMITDAEDKPVQKLRLIDEVQRLGVAYHFEKEIEDAIQKLCPIYIDSNRADLHTVSLHFRLLRQQGIKISCDVFEKFKDDEGRFKSSLINDVQGMLSLYEAAYMAVRGEHILDEAIAFTTTHLKSLVAQDHVTPKLAEQINHALYRPLRKTLPRLEARYFMSMIDSTSDHLYNKTLLNFAKLDFNILLELHKEELNELTKWWKDLDFTTKLPYARDRLVELYFWDLGTYFEPQYAFGRKIMTKLNYILSIIDDTYDAYGTLEELSLFTEAVQRWNIEAVDMLPEYMKLIYRTLLDAFNEIEEDMAKQGRSHCVRYAKEENQKVIGAYSVQAKWFSEGYVPTIEEYMPIALTSCAYRFVITNSFLGMGDFATKEVFEWISNNPKVVKAASVICRLMDDMQGHEFEQKRGHVASAIECYTKQHGVSKEEAIKMFEEEVANAWKDINEELMMKPTVVARPLLGTILNLARAIDFIYKEDDGYTHSYLIKDQIASVLGDHVPF

SEQ ID NO: 19 - protein, 547 aa, Artificial Sequence
  CVS mutant V15
MSSGETFRPTADFHPSLWRNHFLKGASDFKTVDHTATQERHEALKEEVRRMITDAEDKPGQKLRLIDEVQRLGVAYHFEKEIEDAIQKLCPIYIDSNRADLHTVSLHFRLLRQQGIKISCDVFEKFKDDEGRFKSSLINDVQGMLSLYEAAYMAVRGEHILDEAIAFTTTHLKSLVAQDHVTPKLAEQINHALYRPLRKTLPRLEARYFMSMIDSTSDHLYNKTLLNFAKLDFNILLELHKEELNELTKWWKDLDFTTKLPYARDRLVELYFWDLGTYFEPQYAFGRKIMTQLNYILSIIDDTYDAYGTLEELSLFTEAVQRWNIEAVDMLPEYMKLIYRTLLDAFNEIEEDMAKQGRSHCVRYAKEENQKVIGAYSVQAKWFSEGYVPTIEEYMPIALTSCAYRFVITNSFLGMGDFATKEVFEWISNNPKVVKAASVICRLMDDMQGHEFEQKRGHVASAIECYTKQHGVSKEEAIKMFEEEVANAWKDINEELMMKPTVVARPLLGTILNLARAIDFIYKEDDGYTHSYLIKDQIASVLGDHVP

SEQ ID NO: 20 - protein, 547 aa, Artificial Sequence
  CVS mutant V16
MSSGETFRPTADFHPSLWRNHFLKGASDFKTVDHTATQERHEALKEEVRRMITDAEDKPIQKLRLIDEVQRLGVAYHFEKEIEDAIQKLCPIYIDSNRADLHTVSLHFRLLRQQGIKISCDVFEKFKDDEGRFKSSLINDVQGMLSLYEAAYMAVRGEHILDEAIAFTTTHLKSLVAQDHVTPKLAEQINHALYRPLRKTLPRLEARYFMSMIDSTSDHLYNKTLLNFAKLDFNILLELHKEELNELTKWWKDLDFTTKLPYARDRLVELYFWDLGTYFEPQYAFGRKIMTQLNYILSIIDDTYDAYGTLEELSLFTEAVQRWNIEAVDMLPEYMKLIYRTLLDTFNEIEEDMAKQGRSHCVRYAKEENQKVIGAYSVQAKWFSEGYVPTIEEYMPIALTSCAYRFVITNSFLGMGDFATKEVFEWISGNPKVVKAASVICRLMDDMQGHEFEQKRGHVASAIECYTKQHGVSKEEAIKMFEEEVANAWKDINEELMMKPTVVARPLLGTILNLARAIDFIYKEDDGYTHSYLIKDQIASVLGDHVP

SEQ ID NO: 21 - protein, 547 aa, Artificial Sequence
  CVS mutant V17
MSSGETFRPTADFHPSLWRNHFLKGASDFKTVDHTATQERHEALKEEVRRMITDAEDKPIQKLRLIDEVQRLGVAYHFEKEIEDAIQKLCPIYIDSNRADLHTVSLHFRLLRQQGIKISCDVFEKFKDDEGRFKSSLINDVQGMLSLYEAAYMAVRGEHILDEAIAFTTTHLKSLVAQDHVTPKLAEQINHALYRPLRKTLPRLEARYFMSRIDSTSDHLVNKTLLNFAKLDFNILLELHKEELNELTKWWKDLDFTTKLPYARDRLVELYFWDLGTYFEPQYAFGRKIMTQLNYILSIIDDTYDAYGTLEELSLFTEAVQRWNIEAVDMLPEYMKLIYRTLLDTFNEIEEDMAKQGRSHCVRYAKEENQKVIGAYSVQAKWFSEGYVPTIEEYMPIALTSCAYRFVITNSFLGMGDFATKEVFEWISGNPKVVKAASVICRLMDDMQGHEFEQKRGHVASAIECYTKQHGVSKEEAIKMFEEEVANAWKDINEELMMKPTVVARPLLGTILNLARAIDFIYKEDDGYTHSYLIKDQIASVLGDHVP

SEQ ID NO: 22 - protein, 548 aa, Artificial Sequence
  CVS mutant V20
MSSGETFRPTADFHPSLWRNHFLAGASDFKTVDHTATAERHEALKEEVRRMITDAEDAPIQKLRLIDEVQRLGVAYHFEKEIEDAIQALCPIHIDSDKADLHTVSLHFRLLRQQGIKISCDVFEAFKDDEGRFKSSLINDVQGMLSLYEAAYMAVRGEHILDEAIAFTTTHLASLVAQDHVTPRLAEQINHALYRPLRKTLPRLEARYIMSRIDSTSDDLVNKTLLNFAKLDFNILLDLHKEELNELTKWWADLDFTTKLPYARDRLVELYFWDLGTYFEPQYAFGRKIMTKLNYILSIIDDTYDAYGTLEELSLFTEASARWNIKAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 23 - protein, 548 aa, Artificial Sequence
  CVS mutant V21
MSSGETFRPTADFHPSLWRNHFLAGASDFKTVDHTATAERHEALKEEVRGMITDAEDAPIQKLRLIDEVQRLGVAYHFEKEIEDAIQALCPIHIDSDKADLHTVSLHFRLLRQQGIKISCDVFEAFKDDEGRFKSSLINDVQGMLSLYEAAYMAVRGEHILDEAIAFTTTHLASLVAQDHVTPRLAEQINHALYRPLRKTLPRLEARYIMSRIDSTSDDLVNKTLLNFAKLDFNILLDLHKEELNELTKWWADLDFTTKLPYARDRLVELYFWDLGTYFEPQYAFGRKIMTKLNYILSIIDDTYDAYGTLEELSLFTEAGARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 24 - protein, 548 aa, Artificial Sequence
  CVS mutants V22 and V23
MSSGETFRPTADFHPSLWRNHFLAGASDFKTVDHTATAERHEALKEEVRRMITDAEDAPIQKLRLIDEVQRLGVAYHFEKEIEDAIQALCPIHIDSDKADLHTVSLHFRLLRQQGIKISCDVFEAFKDDEGRFKSSLINDVQGMLSLYEAAYMAVRGEHILDEAIAFTTTHLASLVAQDHVTPRLAEQINHALYRPLRKTLPRLEARYIMSRIDSTSDDLVNKTLLNFAKLDFNILLDLHKEELNELTKWWADLDFTTKLPYARDRLVELYFWDLGTYFEPQYAFGRKIMTKLNYILSIIDDTYDAYGTLEELSMFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 25 - protein, 548 aa, Artificial Sequence
  CVS mutants V24 and V33
MSSGETFRPTADFHPSLWRNHFLAGASDFKTVDHTATAERHEALKEEVRRMITDAEDAPIQKLRLIDEVQRLGVAYHFEKEIEDAIQALCPIHIDSDKADLHTVSLHFRLLRQQGIKISCDVFEAFKDDEGRFKSSLINDVQGMLSLYEAAYMAVRGEHILDEAIAFTTTHLASLVAQDHVTPRLAEQINHALYRPLRKTLPRLEARYIMSRIDSTSDDLVNKTLLNFAKLDFNILLDLHKEELNELTKWWADLDFTTKLPYARDRLVELYFWDLGTYFEPQYAFGRKIMTKLNYILSIIDDTYDAYGTLEELSLFTEAGARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 26 - protein, 548 aa, Artificial Sequence
  CVS mutants V27 and V30
MSSGETFRPTADFHPSLWRNHFLAGASDFKTVDHTATAERHEALKEEVRRMITDAEDAPIQKLRLIDEVQRLGVAYHFEKEIEDAIQALCPIHIDSDKADLHTVSLHFRLLRQQGIKISCDVFEAFKDDEGRFKSSLINDVQGMLSLYEAAYMAVRGEHILDEAIAFTTTHLASLVAQDHVTPRLAEQINHALYRPLRKTLPRLEARYIMSRIDSTSDDLVNKTLLNFAKLDFNILLDLHKEELNELTKWWADLDFTTKLPYARDRLVELYFWDLGTYFEPQYAFGRKIMTKLNYILSIIDDTYDAYGTLEELSLFTEAVARWNIEAVDMLPDYMKLIYRTLLDTFNEIEEDMAKQRRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 27 - protein, 548 aa, Artificial Sequence
  CVS mutant V28
MSSGETFRPTADFHPSLWRNHFLAGASDFKTVDHTATAERHEALKEEVRRMITDAEDAPIQKLRLIDEVQRLGVAYHFEKEIEDAIQALCPIHIDSDKADLHTVSLHFRLLRQQGIKISCDVFEAFKDDEGRFKSSLINDVQGMLSLYEAAYMAVRGEHILDEAIAFTTTHLASLVAQDHVTPRLAEQINHALYRPLRKTLPRLEARYIMSRIDSTSDDLVNKTLLNFAKLDFNILLDLHKEELNELTKWWADLDFTTKLPYARDRLVELYFWDLGTYFEPQYAFGRKIMTKLNYILSIIDDTYDAYGTLEELSLFTEAVARWNIEAVDMLPDYMKLIYRTLLDTFNEIEEDMAKQGRSHCVRYAKGEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 28 - protein, 548 aa, Artificial Sequence
  CVS mutant V31
MSSGETFRPTADFHPSLWRNHFLAGASDFKTVDHTATAERHEALKEEVRRMITDAEDAPIQKLRLIDEVQRLGVAYHFEKEIEDAIQALCPIHIDSDKADLHTVSLHFRLLRQQGIKISCDVFEAFKDDEGRFKSSLINDVQGMLSLYEAAYMAVRGEHILDEAIAFTTTHLASLVAQDHVTPRLAEQINHALYRPLRKTLPRLEARYIMSRIDSTSDDLVNKTLLNFAKLDFNILLDLHKEELNELTKWWADLDFTTKLPYARDRLVELYFWDLGTYFEPQYAFGRKIMTKLNYILSIIDDTYDAYGTLEELSLFTEAVARWNIEAVDMLPDYMKLIYRTLLDTFNEIEEDMAKQGRSHCVRYAKEEIDKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 29 - protein, 548 aa, Artificial Sequence
  CVS mutant V32
MSSGETFRPTADFHPSLWRNHFLAGASDFKTVDHTATAERHEALKEEVRRMITDAEDAPIQKLRLIDEVQRLGVAYHFEKEIEDAIQALCPIHIDSDKADLHTVSLHFRLLRQQGIKISCDVFEAFKDDEGRFKSSLINDVQGMLSLYEAAYMAVRGEHILDEAIAFTTTHLASLVAQDHVTPRLAEQINHALYRPLRKTLPRLEARYIMSRIDSTSDDLVNKTLLNFAKLDFNILLDLHKEELNELTKWWADLDFTTKLPYARDRLVELYFWDLGTYFEPQYAFGRKIMTKLNYILSYIDDTYDAYGTLEELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 30 - protein, 548 aa, Artificial Sequence
  CVS mutant V34
MSSGETFRPTADFHPSLWRNHFLAGASDFKTVDHTATAERHEALKEEVRRMITDAEDAPIQKLRLIDEVQRLGVAYHFEKEIEDAIQALCPIHIDSDKADLHTVSLHFRLLRQQGIKISCDVFEAFKDDEGRFKSSLINDVQGMLSLYEAAYMAVRGEHILDEAIAFTTTHLASLVAQDHVTPRLAEQINHALYRPLRKTLPRLEARYIMSRIDSTSDDLVNKTLLNFAKLDFNILLDLHKEELNELTKWWADLDFTTKLPYARDRLVELYFWDLGTYFEPQYAFGRKIMTKLNYILSIIDDTYDAYGTLEELSLFTEAVARWNIEAVDMLPDYMKLIYRTLLDTFNEIEEDMAKQGRSLCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 31 - protein, 548 aa, Artificial Sequence
  CVS mutants V35 and V47
MSSGETFRPTADFHPSLWRNHFLAGASDFKTVDHTATAERHEALKEEVRRMITDAEDAPIQKLRLIDEVQRLGVAYHFEKEIEDAIQALCPIHIDSDKADLHTVSLHFRLLRQQGIKISCDVFEAFKDDEGRFKSSLINDVQGMLSLYEAAYMAVRGEHILDEAIAFTTTHLASLVAQDHVTPRLAEQINHALYRPLRKTLPRLEARYIMSRIDSTSDDLVNKTLLNFAKLDFNILLDLHKEELNELTKWWADLDFTTKLPYARDRLVELYFWDLGTYFEPQYAFGRKIMTKLNYILSIIDDTYDAYGTLEELSLFSEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 32 - protein, 548 aa, Artificial Sequence
  CVS mutants V36
MSSGETFRPTADFHPSLWRNHFLAGASDFKTVDHTATAERHEALKEEVRRMITDAEDAPIQKLRLIDEVQRLGVAYHFEKEIEDAIQALCPIHIDSDKADLHTVSLHFRLLRQQGIKISCDVFEAFKDDEGRFKSSLINDVQGMLSLYEAAYMAVRGEHILDEAIAFTTTHLASLVAQDHVTPRLAEQINHALYRPLRKTLPRLEARYIMSRIDSTSDDLVNKTLLNFAKLDFNILLDLHKEELNELTKWWADLDFTTKLPYARDRLVELYFWDLGTYFEPQYAFGRKIMTKLNYILSIIDDTYDAYGTLEELSLFTEADARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 33 - protein, 548 aa, Artificial Sequence
  CVS mutant V40
MSSGETFRPTADFHPSLWRNHFLAGASDFKTVDHTATVERHEALKEEVRRMITDAEDAPIQKLRLIDEVQRLGVAYHFEKEIEDAIQALCPIHIDSDKADLHTVSLHFRLLRQQGIKISCDVFEAFKDDEGRFKSSLINDVQGMLSLYEAAYMAVRGEHILDEAIAFTTTHLASLVAQDHVTPRLAEQINHALYRPLRKTLPRLEARYIMSRIDSTSDDLVNKTLLNFAKLDFNILLDLHKEELNELTKWWADLDFTTKLPYARDRLVELYFWDLGTYFEPQYAFGRKIMTKLNYILSIIDDTYDAYGTLEELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 34 - protein, 548 aa, Artificial Sequence
  CVS mutant V41
MSSGETFRPTADFHPSLWRNHFLAGASDFKTVDHTATAERHEALKEEVRRMITDAEDAPIQKLRLIDEVQRLGVAYHFEKEIEDAIQALCPIHIDSDKADLHTVSLHFRLLRQQGIKISCDVFEAFKDDEGRFKSSLINDVQGMLSLYEAAYMAVRGEHILDEAIAFTTTHLASLVAQDHVTPRLAEQINHALYRPLRKTLPRLEARYIMSRIDSTSDDLVNKTLLNFAKLDFNILLDLHKEELNELTKWWADLDFTTKLPYARDRLVELYFWDLGTYFEPQYAFGRKIMTKLNYILSIIDDTYDAYGTLEELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVIGNSFLGMGDFATKEVFEWISGNPKVVKSASVICRLMDDMQGHEFEQKRGHVASAIECYTKQHGVSKEEAIKMFEEEVANAWKDINEGLMMKPPVVARPLLGTILNLARAIDFIYKEDDGYTHSYLIKEQIASVLGDHVPF

SEQ ID NO: 35 - protein, 548 aa, Artificial Sequence
  CVS mutant V42
MSSGETFRPTADFHPSLWRNHFLAGASDFKTVDHTATAERHEALKEEVRRMITDAEDAPIQKLRLIDEVQRLGVAYHFEKEIEDAIQALCPIHIDSDKADLHTVSLHFRLLRQQGIKISCDVFEAFKDDEGRFKSSLINDVQGMLSLYEAAYMAVRGEHILDEAIAFTTTHLASLVAQDHVTPRLAEQINHALYRPLRKTLPRLEARYIMSRIDSTSDDLVNKTLLNFAKLDFNILLDLHKEELNELTKWWADLDFTTKLPYARDRLVELYFWDLGTYFESQYAFGRKIMTKLNYILSIIDDTYDAYGTLEELSLFTEAVARWNIEAVDMLPDYMKIIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 36 - protein, 548 aa, Artificial Sequence
  CVS mutant V43
MSSGETFRPTADFHPSLWRNHFLAGASDFKTVDHTATAERHEALKEEVRRMITDAEDAPIQKLRLIDEVQRLGVAYHFEKEIEDAIQALCPIHIDSDKADLHTVSLHFRLLRQQGIKISCDVFEAFKDDEGRFKSSLINDVQGMLSLYEAAYMAVRGEHILDEAIAFTTTHLASLVAQDHVTPRLAEQINHALYRPLRKTLPRLEARYIMSRIDSTSDDLVNKTLLNFAKLDFNILLDLHKEELNELTKWWADLDFTTKLPYARDRLVELYFWDLGTYFEPQYAFGRKIMTKLNYILSIIDDTYDAYGTLEELSLFTEAVARWNIEAVDMLPDYMKLIYRTLLDTFNEIEEDMAKQGRSHCVRYAKEEIQKVIGDYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 37 - protein, 548 aa, Artificial Sequence
  CVS mutant V44
MSSGETFRPTADFHPSLWRNHFLAGASDFKTVDHTATAERHEALKEEVRRMITDAEDAPIQKLRLIDEVQRLGVAYHFEKEIEDAIQALCPIHIDSDKADLHTVSLHFRLLRQQGIKISCDVFEAFKDDEGRFKSSLINDVQGMLSLYEAAYMAVRGEHILDEAIAFTTTHLASLVAQDHVTPRLAEQINHALYRPLRKTLPRLEARYIMSRIDSTSDDLVNKTLLNFAKLDFNILLDLHKEELNELTKWWADLDFTTKLPYARDRLVELYFWDLGTYFEPQYAFGRKIMTKLNYILSIIDDTYDAYGTLEELSLFTEAVARWNIEAVDMLPDYMRLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 38 - protein, 548 aa, Artificial Sequence
  CVS mutant V45
MSSGETFRPTADFHPSLWRNHFLAGASDFKTVDHTATAERHEALKEEVRRMITDAEDAPIQKLRLIDEVQRLGVAYHFEKEIEDAIQALCPIHIDSDKADLHTVSLHFRLLRQQGIKISCDVFEAFKDDEGRFKSSLINDVQGMLSLYEAAYMAVRGEHILDEAIAFTTTHLASLVAQDHVTPRLAEQINHALYRPLRKTLPRLEARYIMSRIDSTSDDLVNKTLLNFAKLDFNILLDLHKEELNELTKWWADLDFTTKLPYARDRLVELYFWDLGTYFEPQYAFGRKIMTKLNYILSIIDDTYDAYGTLPELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 39 - protein, 548 aa, Artificial Sequence
  CVS mutant V46
MSSGETFRPTADFHPSLWRNHFLAGASDFKTVDHTATAERHEALKEEVRRMITDAEDAPIQKLRLIDEVQRLGVAYHFEKEIEDAIQALCPIHIDSDKADLHTVSLHFRLLRQQGIKISCDVFEAFKDDEGRFKSSLINDVQGMLSLYEAAYMAVRGEHILDEAIAFTTTHLASLVAQDHVTPRLAEQINHALYRPLRKTLPRLEARYIMSRIDSTSDDLVNKTLLNFAKLDFNILLDLHKEELNELTKWWADLDFTTKLPYARDRLVELYFWDLGTYFEPQYAFGRKIMTKLNYILSIIDDTYDAYGTLEELSLFTEAVARWNIEAVDMLPDYMKLIYRTLLDTFNEIEEDMAKQGRSHCVRYAKEEIHKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 40 - protein, 548 aa, Artificial Sequence
  CVS mutant V48
MSSGETFRPTADFHPSLWRNHFLAGASDFKTVDHTATAERHEALKEEVRRMITDAEDAPIQKLRLIDEVQRLGVAYHFEKEIEDAIQALCPIHIDSDKADLHTVSLHFRLLRQQGIKISCDVFEAFKDDEGRFKSSLINDVQGMLSLYEAAYMAVRGEHILDEAIAFTTTHLASLVAQDHVTPRLAEQINHALYRPLRKTLPRLEARYIMSRIDSTSDDLVNKTLLNFAKLDFNILLDLHKEELNELTKWWADLDFTTKLPYARDRLVELYFWDLGTYFEPQYAFGRKIMTKLNYILSIIDDTYDAYGTLEELSLFTEAVARWNIEAVDMLPDYMKLIYRTLVDTFNEIEEDMAKQGRSACVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 41 - protein, 548 aa, Artificial Sequence
  CVS mutant V49
MSSGETFRPTADFHPSLWRNHFLAGASDFKTVDHTATAERHEALKEEVRRMITDAEDAPIQKLRLIDEVQRLGVAYHFEKEIEDAIQALCPIHIDSDKADLHTVSLHFRLLRQQGIKISCDVFEAFKDDEGRFKSSLINDVQGMLSLYEAAYMAVRGEHILDEAIAFTTTHLASLVAQDHVTPRLAEQINHALYRPLRKTLPRLEARYIMSRIDSTSDDLVNKTLLNFAKLDFNILLDLHKEELNELTKWWADLDFTTKLPYARDRLVELYFWDLGTYFEPSYAFGRKIMTKLNYILSIIDDTYDAYGTLEELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 42 - protein, 548 aa, Artificial Sequence
  CVS mutant V50
MSSGETFRPTADFHPSLWRNHFLAGASDFKTVDHTATAERHEALKEEVRRMITDAEDAPIQKLRLIDEVQRLGVAYHFEKEIEDAIQALCPIHIDSDKADLHTVSLHFRLLRQQGIKISCDVFEAFKDDEGRFKSSLINDVQGMLSLYEAAYMAVRGEHILDEAIAFTTTHLASLVAQDHVTPRLAEQINHALYRPLRKTLPRLEARYIMSRIDSTSDDLVNKTLLNFAKLDFNILLDLHKEELNELTKWWADLDFTTKLPYARDRLVELYFWDLGTYFEPQYAFGRKIMTKLNYILSIIDDTYDAYGTLEELSLFTEAVARWNIEAVDMLPDYMKLIYRTLLDTFNEIEEDMAKQGRSHCVRYAKEEIQGVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 43 - protein, 548 aa, Artificial Sequence
  CVS mutant V51
MSSGETFRPTADFHPSLWRNHFLAGASDFKTVDHTATAERHEALKEEVRRMITDAEDAPIQKLRLIDEVQRLGVAYHFEKEIEDAIQALCPIHIDSDKADLHTVSLHFRLLRQQGIKISCDVFEAFKDDEGRFKSSLINDVQGMLSLYEAAYMAVRGEHILDEAIAFTTTHLASLVAQDHVTPRLAEQINHALYRPLRKTLPRLEARYIMSRIDSTSDDLVNKTLLNFAKLDFNILLDLHKEELNELTKWWADLDFTTKLPYARDRLVELYFWDLGTYFEPQYAFGRKIMTKLNYILSIIDDTYDAYGTLEELSLFTEAVARWNIEAVDMLPDYMKLIYRTLLDTFLEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 44 - protein, 548 aa, Artificial Sequence
  CVS mutant V52
MSSGETFRPTADFHPSLWRNHFLAGASDFKTVDHTATAERHEALKEEVRRMITDAEDAPIQKLRLIDEVQRLGVAYHFEKEIEDAIQALCPIHIDSDKADLHTVSLHFRLLRQQGIKISCDVFEAFKDDEGRFKSSLINDVQGMLSLYEAAYMAVRGEHILDEAIAFTTTHLASLVAQDHVTPRLAEQINHALYRPLRKTLPRLEARYIMSRIDSTSDDLVNKTLLNFAKLDFNILLDLHKEELNELTKWWADLDFTTKLPYARDRLVELYFWDLGTYFEPQYAFGRKIMTKLNYILSIIDDTYDAYGTLTELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 45 - protein, 548 aa, Artificial Sequence
  CVS mutant V53
MSSGETFRPTADFHPSLWRNHFLAGASDFKTVDHTATAERHEALKEEVRRMITDAEDAPIQKLRLIDEVQRLGVAYHFEKEIEDAIQALCPIHIDSDKADLHTVSLHFRLLRQQGIKISCDVFEAFKDDEGRFKSSLINDVQGMLSLYEAAYMAVRGEHILDEAIAFTTTHLASLVAQDHVTPRLAEQINHALYRPLRKTLPRLEARYIMSRIDSTSDDLVNKTLLNFAKLDFNILLDLHKEELNELTKWWADLDFTTKLPYARDRLVELYFWDLGTYFEPLYAFGRKIMTKLNYILSIIDDTYDAYGTLEELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 46 - protein, 548 aa, Artificial Sequence
  CVS mutant V54
MSSGETFRPTADFHPSLWRNHFLAGASDFKTVDHTATAERHEALKEEVRRMITDAEDAPIQKLRLIDEVQRLGVAYHFEKEIEDAIQALCPIHIDSDKADLHTVSLHFRLLRQQGIKISCDVFEAFKDDEGRFKSSLINDVQGMLSLYEAAYMAVRGEHILDEAIAFTTTHLASLVAQDHVTPRLAEQINHALYRPLRKTLPRLEARYIMSRIDSTSDDLVNKTLLNFAKLDFNILLDLHKEELNELTKWWADLDFTTKLPYARDRLVELYFWDLGTYFEPQYAFGRKIMTKLNYILSIIDDTYDAYGTLEELTLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 47 - protein, 548 aa, Artificial Sequence
  CVS mutant V55
MSSGETFRPTADFHPSLWRNHFLAGASDFKTVDHTATAERHEALKEEVRRMITDAEDAPIQKLRLIDEVQRLGVAYHFEKEIEDAIQALCPIHIDSDKADLHTVSLHFRLLRQQGIKISCDVFEAFKDDEGRFKSSLINDVQGMLSLYEAAYMAVRGEHILDEAIAFTTTHLASLVAQDHVTPRLAEQINHALYRPLRKTLPRLEARYIMSRIDSTSDDLVNKTLLNFAKLDFNILLDLHKEELNELTKWWADLDFTTKLPYARDRLVELYFWDLGTYFEPQYAFGRKIMTKLNYILSIIDDTYDAYGTLEELSLFTEAVARWNIEAVDMLPDYMKLIYRTLLDTFNEIEEDMAKQGRSHCVRYAKEEIGKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 48 - protein, 548 aa, Artificial Sequence
  CVS mutant V56
MSSGETFRPTADFHPSLWRNHFLAGASDFKTVDHTATAERHEALKEEVRRMITDAEDAPIQKLRLIDEVQRLGVAYHFEKEIEDAIQALCPIHIDSDKADLHTVSLHFRLLRQQGIKISCDVFEAFKDDEGRFKSSLINDVQGMLSLYEAAYMAVRGEHILDEAIAFTTTHLASLVAQDHVTPRLAEQINHALYRPLRKTLPRLEARYIMSRIDSTSDDLVNKTLLNFAKLDFNILLDLHKEELNELTKWWADLDFTTKLPYARDRLVELYFWDLGTYFEPQYAFGRKIMTKLNYILSIIDDTYDAYGTHEELSLFTEAVARWNIEAVDMLPDYMKLIYRTLLDTFNEIEEDMAKQGRSHCARYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 49 - protein, 548 aa, Artificial Sequence
  CVS mutant V57
MSSGETFRPTADFHPSLWRNHFLAGASDFKTVDHTATAERHEALKEEVRRMITDAEDAPIQKLRLIDEVQRLGVAYHLEKEIEDAIQALCPIHIDSDKADLHTVSLHFRLLRQQGIKISCDVFEAFKDDEGRFKSSLINDVQGMLSLYEAAYMAVRGEHILDEAIAFTTTHLASLVAQDHVTPRLAEQINHALYRPLRKTLPRLEARYIMSRIDSTSDDLVNKTLLNFAKLDFNILLDLHKEELNELTKWWADLDFTTKLPYARDRLVELYFWDLGTYFEPQYAFGRKIMTKLNYILSIIDDTYDAYGTLEECSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 50 - protein, 548 aa, Artificial Sequence
  CVS mutants V58 and V59
MSSGETFRPTADFHPSLWRNHFLQGASDFKTVDHTATNERHEALKEEVRRMITDAEDQPIQKLRLIDEVQRLGVAYHFEKEIEDAIQQLCPIHIDSDKADLHTVSLHFRLLRQQGIKISCDVFEQFKDDEGRFKSSLINDVQGMLSLYEAAYMAVRGEHILDEAIAFTTTHLQSLVAQDHVTPRLAEQINHALYRPLRKTLPRLEARYIMSRIDSTSDDLVNKTLLNFAKLDFNILLDLHKEELNELTKWWQDLDFTTKLPYARDRLVELYFWDLGTYFESQYAFGRKIMTKLNYILSYIDDTYDAYGTHPELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 51 - protein, 548 aa, Artificial Sequence
  CVS mutant V60
MSSGETFRPTADFHPSLWRNHFLQGASDFKTVDHTATNERHEALKEEVRRMITDAEDQPIQKLRLIDEVQRLGVAYHFEKEIEDAIQQLCPIHIDSDKADLHTVSLHFRLLRQQGIKISCDVFEQFKDDEGRFKSSLINDVQGMLSLYEAAYMAVRGEHILDEAIAFTTTHLQSLVAQDHVTPRLAEQINHALYRPLRKTLPRLEARYIMSRIDSTSDDLVNKTLLNFAKLDFNILLDLHKEELNELTKWWQDLDFTTKLPYARDRLVELYFWDLGTYFESLYAFGRKIMTKLNYILSIIDDTYDAYGTHEELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 52 - protein, 548 aa, Artificial Sequence
  CVS mutant V61
MSSGETFRPTADFHPSLWRNHFLQGASDFKTVDHTATNERHEALKEEVRRMITDAEDQPIQKLRLIDEVQRLGVAYHFEKEIEDAIQQLCPIHIDSDKADLHTVSLHFRLLRQQGIKISCDVFEQFKDDEGRFKSSLINDVQGMLSLYEAAYMAVRGEHILDEAIAFTTTHLQSLVAQDHVTPRLAEQINHALYRPLRKTLPRLEARYIMSRIDSTSDDLVNKTLLNFAKLDFNILLDLHKEELNELTKWWQDLDFTTKLPYARDRLVELYFWDLGTYFESLYAFGRKIMTKLNYILSYIDDTYDAYGTLPELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 53 - protein, 548 aa, Artificial Sequence
  CVS mutant V62
MSSGETFRPTADFHPSLWRNHFLQGASDFKTVDHTATNERHEALKEEVRRMITDAEDQPIQKLRLIDEVQRLGVAYHFEKEIEDAIQQLCPIHIDSDKADLHTVSLHFRLLRQQGIKISCDVFEQFKDDEGRFKSSLINDVQGMLSLYEAAYMAVRGEHILDEAIAFTTTHLQSLVAQDHVTPRLAEQINHALYRPLRKTLPRLEARYIMSRIDSTSDDLVNKTLLNFAKLDFNILLDLHKEELNELTKWWQDLDFTTKLPYARDRLVELYFWDLGTYFESQYAFGRKIMTKLNYILSIIDDTYDAYGTLEECTMFSEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 54 - protein, 548 aa, Artificial Sequence
  CVS mutant V63
MSSGETFRPTADFHPSLWRNHFLQGASDFKTVDHTATNERHEALKEEVRRMITDAEDQPIQKLRLIDEVQRLGVAYHFEKEIEDAIQQLCPIHIDSDKADLHTVSLHFRLLRQQGIKISCDVFEQFKDDEGRFKSSLINDVQGMLSLYEAAYMAVRGEHILDEAIAFTTTHLQSLVAQDHVTPRLAEQINHALYRPLRKTLPRLEARYIMSRIDSTSDDLVNKTLLNFAKLDFNILLDLHKEELNELTKWWQDLDFTTKLPYARDRLVELYFWDLGTYFESQYAFGRKIMTKLNYILSIIDDTYDAYGTLEELSLFTEAVARWNIEAVDMLPDYMRLIYRTLLDTFLEIEEDMAKQRRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 55 - protein, 548 aa, Artificial Sequence
  CVS mutants V64 and V65
MSSGETFRPTADFHPSLWRNHFLQGASDFKTVDHTATNERHEALKEEVRRMITDAEDQPIQKLRLIDEVQRLGVAYHFEKEIEDAIQQLCPIHIDSDKADLHTVSLHFRLLRQQGIKISCDVFEQFKDDEGRFKSSLINDVQGMLSLYEAAYMAVRGEHILDEAIAFTTTHLQSLVAQDHVTPRLAEQINHALYRPLRKTLPRLEARYIMSRIDSTSDDLVNKTLLNFAKLDFNILLDLHKEELNELTKWWQDLDFTTKLPYARDRLVELYFWDLGTYFEPQYAFGRKIMTKLNYILSIIDDTYDAYGTHTECTMFSEAGARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 56 - protein, 548 aa, Artificial Sequence
  CVS mutant V66
MSSGETFRPTADFHPSLWRNHFLQGASDFKTVDHTATNERHEALKEEVRRMITDAEDQPIQKLRLIDEVQRLGVAYHFEKEIEDAIQQLCPIHIDSDKADLHTVSLHFRLLRQQGIKISCDVFEQFKDDEGRFKSSLINDVQGMLSLYEAAYMAVRGEHILDEAIAFTTTHLQSLVAQDHVTPRLAEQINHALYRPLRKTLPRLEARYIMSRIDSTSDDLVNKTLLNFAKLDFNILLDLHKEELNELTKWWQDLDFTTKLPYARDRLVELYFWDLGTYFESQYAFGRKIMTKLNYILSIIDDTYDAYGTLEELSLFSEAVARWNIEAVDMLPDYMRIIYRTLLDTFLEIEEDMAKQRRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 57 - protein, 548 aa, Artificial Sequence
  CVS mutant V67
MSSGETFRPTADFHPSLWRNHFLQGASDFKTVDHTATNERHEALKEEVRRMITDAEDQPIQKLRLIDEVQRLGVAYHFEKEIEDAIQQLCPIHIDSDKADLHTVSLHFRLLRQQGIKISCDVFEQFKDDEGRFKSSLINDVQGMLSLYEAAYMAVRGEHILDEAIAFTTTHLQSLVAQDHVTPRLAEQINHALYRPLRKTLPRLEARYIMSRIDSTSDDLVNKTLLNFAKLDFNILLDLHKEELNELTKWWQDLDFTTKLPYARDRLVELYFWDLGTYFEPQYAFGRKIMTKLNYILSIIDDTYDAYGTLEELSLFSEAVARWNIEAVDMLPDYMRIIYRTLLDTFNEIEEDMAKQRRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 58 - protein, 548 aa, Artificial Sequence
  CVS mutant V68
MSSGETFRPTADFHPSLWRNHFLQGASDFKTVDHTATNERHEALKEEVRRMITDAEDQPIQKLRLIDEVQRLGVAYHFEKEIEDAIQQLCPIHIDSDKADLHTVSLHFRLLRQQGIKISCDVFEQFKDDEGRFKSSLINDVQGMLSLYEAAYMAVRGEHILDEAIAFTTTHLQSLVAQDHVTPRLAEQINHALYRPLRKTLPRLEARYIMSRIDSTSDDLVNKTLLNFAKLDFNILLDLHKEELNELTKWWQDLDFTTKLPYARDRLVELYFWDLGTYFESQYAFGRKIMTKLNYILSIIDDTYDAYGTLEELSLFSEAVARWNIEAVDMLPDYMRLIYRTLLDTFLEIEEDMAKQRRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 59 - protein, 548 aa, Artificial Sequence
  CVS mutant V69
MSSGETFRPTADFHPSLWRNHFLQGASDFKTVDHTATNERHEALKEEVRRMITDAEDQPIQKLRLIDEVQRLGVAYHFEKEIEDAIQQLCPIHIDSDKADLHTVSLHFRLLRQQGIKISCDVFEQFKDDEGRFKSSLINDVQGMLSLYEAAYMAVRGEHILDEAIAFTTTHLQSLVAQDHVTPRLAEQINHALYRPLRKTLPRLEARYIMSRIDSTSDDLVNKTLLNFAKLDFNILLDLHKEELNELTKWWQDLDFTTKLPYARDRLVELYFWDLGTYFESQYAFGRKIMTKLNYILSIIDDTYDAYGTLEELSLFSEAVARWNIEAVDMLPDYMKLIYRTLLDTFNEIEEDMAKQRRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 60 - protein, 548 aa, Artificial Sequence
  CVS mutant V70
MSSGETFRPTADFHPSLWRNHFLQGASDFKTVDHTATNERHEALKEEVRRMITDAEDQPIQKLRLIDEVQRLGVAYHFEKEIEDAIQQLCPIHIDSDKADLHTVSLHFRLLRQQGIKISCDVFEQFKDDEGRFKSSLINDVQGMLSLYEAAYMAVRGEHILDEAIAFTTTHLQSLVAQDHVTPRLAEQINHALYRPLRKTLPRLEARYIMSRIDSTSDDLVNKTLLNFAKLDFNILLDLHKEELNELTKWWQDLDFTTKLPYARDRLVELYFWDLGTYFESQYAFGRKIMTKLNYILSIIDDTYDAYGTHTECSLFSEAGARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 61 - protein, 548 aa, Artificial Sequence
  CVS mutant V71
MSSGETFRPTADFHPSLWRNHFLQGASDFKTVDHTATNERHEALKEEVRRMITDAEDQPIQKLRLIDEVQRLGVAYHFEKEIEDAIQQLCPIHIDSDKADLHTVSLHFRLLRQQGIKISCDVFEQFKDDEGRFKSSLINDVQGMLSLYEAAYMAVRGEHILDEAIAFTTTHLQSLVAQDHVTPRLAEQINHALYRPLRKTLPRLEARYIMSRIDSTSDDLVNKTLLNFAKLDFNILLDLHKEELNELTKWWQDLDFTTKLPYARDRLVELYFWDLGTYFESQYAFGRKIMTKLNYILSIIDDTYDAYGTLEECTMFSEAVARWNIEAVDMLPDYMRLIYRTLLDTFLEIEEDMAKQRRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 62 - protein, 548 aa, Artificial Sequence
  CVS mutant V72
MSSGETFRPTADFHPSLWRNHFLQGASDFKTVDHTATNERHEALKEEVRRMITDAEDQPIQKLRLIDEVQRLGVAYHFEKEIEDAIQQLCPIHIDSDKADLHTVSLHFRLLRQQGIKISCDVFEQFKDDEGRFKSSLINDVQGMLSLYEAAYMAVRGEHILDEAIAFTTTHLQSLVAQDHVTPRLAEQINHALYRPLRKTLPRLEARYIMSRIDSTSDDLVNKTLLNFAKLDFNILLDLHKEELNELTKWWQDLDFTTKLPYARDRLVELYFWDLGTYFEPQYAFGRKIMTKLNYILSIIDDTYDAYGTLEELSLFTEAVARWNIEAVDMLPDYMKLIYRTLLDTFNEIEEDMAKQGRSHCVRYAKEEIDKVIGDYYVQAKWFSEGYVPTIEEYMPIALTSCAYRFVIGNSFLGMGDFATKEVFEWISGNPKVVKSASVICRLMDDMQGHEFEQKRGHVASAIECYTKQHGVSKEEAIKMFEEEVANAWKDINEGLMMKPPVVARPLLGTILNLARAIDFIYKEDDGYTHSYLIKEQIASVLGDHVPF

SEQ ID NO: 63 - protein, 548 aa, Artificial Sequence
  CVS mutants V73 and V74
MSSGETFRPTADFHPSLWRNHFLQGASDFKTVDHTATNERHEALKEEVRRMITDAEDQPIQKLRLIDEVQRLGVAYHFEKEIEDAIQQLCPIHIDSDKADLHTVSLHFRLLRQQGIKISCDVFEQFKDDEGRFKSSLINDVQGMLSLYEAAYMAVRGEHILDEAIAFTTTHLQSLVAQDHVTPRLAEQINHALYRPLRKTLPRLEARYIMSRIDSTSDDLVNKTLLNFAKLDFNILLDLHKEELNELTKWWQDLDFTTKLPYARDRLVELYFWDLGTYFESQYAFGRKIMTKLNYILSIIDDTYDAYGTLEECTMFSEAVARWNIEAVDMLPDYMRIIYRTLLDTFLEIEEDMAKQRRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 64 - protein, 548 aa, Artificial Sequence
  CVS mutant V77
MRDKGTCRPTADFHPSLWRNHFLQGASDFKTVDHTATNERHEALKEEVRRMITDAEDQPIQKLRLIDEVQRLGVAYHFEKEIEDAIQQLCPIHIDSDKADLHTVSLHFRLLRQQGIKISCDVFEQFKDDEGRFKSSLINDVQGMLSLYEAAYMAVRGEHILDEAIAFTTTHLQSLVAQDHVTPRLAEQINHALYRPLRKTLPRLEARYIMSRIDSTSDDLVNKTLLNFAKLDFNILLDLHKEELNELTKWWQDLDFTTKLPYARDRLVELYFWDLGTYFEPQYAFGRKIMTKLNYILSIIDDTYDAYGTLEELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 65 - protein, 548 aa, Artificial Sequence
  CVS mutant V78
MEGNSVQRPTADFHPSLWRNHFLQGASDFKTVDHTATNERHEALKEEVRRMITDAEDQPIQKLRLIDEVQRLGVAYHFEKEIEDAIQQLCPIHIDSDKADLHTVSLHFRLLRQQGIKISCDVFEQFKDDEGRFKSSLINDVQGMLSLYEAAYMAVRGEHILDEAIAFTTTHLQSLVAQDHVTPRLAEQINHALYRPLRKTLPRLEARYIMSRIDSTSDDLVNKTLLNFAKLDFNILLDLHKEELNELTKWWQDLDFTTKLPYARDRLVELYFWDLGTYFEPQYAFGRKIMTKLNYILSIIDDTYDAYGTLEELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVLEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 66 - protein, 548 aa, Artificial Sequence
  CVS mutant V79
MKRVGRARPTADFHPSLWRNHFLQGASDFKTVDHTATNERHEALKEEVRRMITDAEDQPIQKLRLIDEVQRLGVAYHFEKEIEDAIQQLCPIHIDSDKADLHTVSLHFRLLRQQGIKISCDVFEQFKDDEGRFKSSLINDVQGMLSLYEAAYMAVRGEHILDEAIAFTTTHLQSLVAQDHVTPRLAEQINHALYRPLRKTLPRLEARYIMSRIDSTSDDLVNKTLLNFAKLDFNILLDLHKEELNELTKWWQDLDFTTKLPYARDRLVELYFWDLGTYFEPQYAFGRKIMTKLNYILSIIDDTYDAYGTLEELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 67 - protein, 548 aa, Artificial Sequence
  CVS mutant V228
MSSGETFRPTADFHPSLWRNHFLQGASDFKTVDHTATNERHEALKEEVRRMILATGRKPIQKLRLIDEVQRLGVAYHFEKEIEDAIQQLCPIHIDSDKADLHTVSLHFRLLRQQGIKISCDVFEQFKDDEGRFKSSLINDVQGMLSLYEAAYMAVRGEHILDEAIAFTTTHLQSLVAQDHVTPRLAEQINHALYRPLRKTLPRLEARYIMSRIDSTSDDLVNKTLLNFAKLDFNILLDLHKEELNELTKWWQDLDFTTKLPYARDRLVELYFWDLGTYFEPQYAFGRKIMTKLNYILSIIDDTYDAYGTLEELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 68 - protein, 548 aa, Artificial Sequence
  CVS mutants V80 and V81
MSSGETFRPTADFHPSLWRNHFLAGASDFKTVDHTATAERHEALKEEVRRMITDAEDAPIQKLRLIDEVQRLGVAYHFEKEIEDAIQALCPIHIDSDKADLHTVSLHFRLLRQQGIKISCDVFEAFKDDEGRFKSSLINDVQGMLSLYEAAYMAVRGEHILDEAIAFTTTHLASLVAQDHVTPRLAEQINHALYRPLRKTLPRLEARYIMSRIDSTSDDLVNKTLLNFAKLDFNILLDLHKEELNELTKWWADLDFTTKLPYARDRLVELYFWMLGTYFEPQYAFGRKIMTKLNYILSIIDDTYDAYGTLEELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 69 - protein, 548 aa, Artificial Sequence
  CVS mutants V82 and V83
MSSGETFRPTADFHPSLWRNHFLAGASDFKTVDHTATAERHEALKEEVRRMITDAEDAPIQKLRLIDEVQRLGVAYHFEKEIEDAIQALCPIHIDSDKADLHTVSLHFRLLRQQGIKISCDVFEAFKDDEGRFKSSLINDVQGMLSLYEAAYMAVRGEHILDEAIAFTTTHLASLVAQDHVTPRLAEQINHALYRPLRKTLPRLEARYIMSRIDSTSDDLVNKTLLNFAKLDFNILLDLHKEELNELTKWWADLDFTTKLPYARDRLVELYFWNLGTYFEPQYAFGRKIMTKLNYILSIIDDTYDAYGTLEELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 70 - protein, 548 aa, Artificial Sequence
  CVS mutant V85
MSSGETFRPTADFHPSLWRNHFLAGASDFKTVDHTATAERHEALKEEVRRMITDAEDAPIQKLRLIDEVQRLGVAYHFEKEIEDAIQALCPIHIDSDKADLHTVSLHFRLLRQQGIKISCDVFEAFKDDEGRFKSSLINDVQGMLSLYEAAYMAVRGEHILDEAIAFTTTHLASLVAQDHVTPRLAEQINHALYRPLRKTLPRLEARYIMSRIDSTSDDLVNKTLLNFAKLDFNILLDLHKEELNELTKWWADLDFTTKLPYARDRLVELYFWSLGTYFEPQYAFGRKIMTKLNYILSIIDDTYDAYGTLEELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 71 - protein, 548 aa, Artificial Sequence
  CVS mutant V86
MSSGETFRPTADFHPSLWRNHFLAGASDFKTVDHTATAERHEALKEEVRRMITDAEDAPIQKLRLIDEVQRLGVAYHFEKEIEDAIQALCPIHIDSDKADLHTVSLHFRLLRQQGIKISCDVFEAFKDDEGRFKSSLINDVQGMLSLYEAAYMAVRGEHILDEAIAFTTTHLASLVAQDHVTPRLAEQINHALYRPLRKTLPRLEARYIMSRIDSTSDDLVNKTLLNFAKLDFNILLDLHKEELNELTKWWADLDFTTKLPYARDRLVELYFWFLGTYFEPQYAFGRKIMTKLNYILSIIDDTYDAYGTLEELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 72 - protein, 548 aa, Artificial Sequence
  CVS mutants V87, V88, V89 and V90
MSSGETFRPTADFHPSLWRNHFLAGASDFKTVDHTATAERHEALKEEVRRMITDAEDAPIQKLRLIDEVQRLGVAYHFEKEIEDAIQALCPIHIDSDKADLHTVSLHFRLLRQQGIKISCDVFEAFKDDEGRFKSSLINDVQGMLSLYEAAYMAVRGEHILDEAIAFTTTHLASLVAQDHVTPRLAEQINHALYRPLRKTLPRLEARYIMSRIDSTSDDLVNKTLLNFAKLDFNILLDLHKEELNELTKWWADLDFTTKLPYARDRLVELYFWGLGTYFEPQYAFGRKIMTKLNYILSIIDDTYDAYGTLEELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 73 - protein, 548 aa, Artificial Sequence
  CVS mutant V91
MSSGETFRPTADFHPSLWRNHFLAGASDFKTVDHTATAERHEALKEEVRRMITDAEDAPIQKLRLIDEVQRLGVAYHFEKEIEDAIQALCPIHIDSDKADLHTVSLHFRLLRQQGIKISCDVFEAFKDDEGRFKSSLINDVQGMLSLYEAAYMAVRGEHILDEAIAFTTTHLASLVAQDHVTPRLAEQINHALYRPLRKTLPRLEARYIMSRIDSTSDDLVNKTLLNFAKLDFNILLDLHKEELNELTKWWADLDFTTKLPYARDRLVELYFWHLGTYFEPQYAFGRKIMTKLNYILSIIDDTYDAYGTLEELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 74 - protein, 548 aa, Artificial Sequence
  CVS mutant V93
MSSGETFRPTADFHPSLWRNHFLAGASDFKTVDHTATAERHEALKEEVRRMITDAEDAPIQKLRLIDEVQRLGVAYHFEKEIEDAIQALCPIHIDSDKADLHTVSLHFRLLRQQGIKISCDVFEAFKDDEGRFKSSLINDVQGMLSLYEAAYMAVRGEHILDEAIAFTTTHLASLVAQDHVTPRLAEQINHALYRPLRKTLPRLEARYIMSRIDSTSDDLVNKTLLNFAKLDFNILLDLHKEELNELTKWWADLDFTTKLPYARDRLVELYFWELGTYFEPQYAFGRKIMTKLNYILSIIDDTYDAYGTLEELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 75 - protein, 548 aa, Artificial Sequence
  CVS mutants V94, V95 and V96
MSSGETFRPTADFHPSLWRNHFLAGASDFKTVDHTATAERHEALKEEVRRMITDAEDAPIQKLRLIDEVQRLGVAYHFEKEIEDAIQALCPIHIDSDKADLHTVSLHFRLLRQQGIKISCDVFEAFKDDEGRFKSSLINDVQGMLSLYEAAYMAVRGEHILDEAIAFTTTHLASLVAQDHVTPRLAEQINHALYRPLRKTLPRLEARYIMSRIDSTSDDLVNKTLLNFAKLDFNILLDLHKEELNELTKWWADLDFTTKLPYARDRLVELYFWDLGTYSEPQYAFGRKIMTKLNYILSIIDDTYDAYGTLEELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 76 - protein, 548 aa, Artificial Sequence
  CVS mutant V97
MSSGETFRPTADFHPSLWRNHFLAGASDFKTVDHTATAERHEALKEEVRRMITDAEDAPIQKLRLIDEVQRLGVAYHFEKEIEDAIQALCPIHIDSDKADLHTVSLHFRLLRQQGIKISCDVFEAFKDDEGRFKSSLINDVQGMLSLYEAAYMAVRGEHILDEAIAFTTTHLASLVAQDHVTPRLAEQINHALYRPLRKTLPRLEARYIMSRIDSTSDDLVNKTLLNFAKLDFNILLDLHKEELNELTKWWADLDFTTKLPYARDRLVELYFWDLGTYIEPQYAFGRKIMTKLNYILSIIDDTYDAYGTLEELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 77 - protein, 548 aa, Artificial Sequence
  CVS mutants V99 and V100
MSSGETFRPTADFHPSLWRNHFLAGASDFKTVDHTATAERHEALKEEVRRMITDAEDAPIQKLRLIDEVQRLGVAYHFEKEIEDAIQALCPIHIDSDKADLHTVSLHFRLLRQQGIKISCDVFEAFKDDEGRFKSSLINDVQGMLSLYEAAYMAVRGEHILDEAIAFTTTHLASLVAQDHVTPRLAEQINHALYRPLRKTLPRLEARYIMSRIDSTSDDLVNKTLLNFAKLDFNILLDLHKEELNELTKWWADLDFTTKLPYARDRLVELYFWDLGTYPEPQYAFGRKIMTKLNYILSIIDDTYDAYGTLEELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 78 - protein, 548 aa, Artificial Sequence
  CVS mutant V101
MSSGETFRPTADFHPSLWRNHFLAGASDFKTVDHTATAERHEALKEEVRRMITDAEDAPIQKLRLIDEVQRLGVAYHFEKEIEDAIQALCPIHIDSDKADLHTVSLHFRLLRQQGIKISCDVFEAFKDDEGRFKSSLINDVQGMLSLYEAAYMAVRGEHILDEAIAFTTTHLASLVAQDHVTPRLAEQINHALYRPLRKTLPRLEARYIMSRIDSTSDDLVNKTLLNFAKLDFNILLDLHKEELNELTKWWADLDFTTKLPYARDRLVELYFWDLGTYDEPQYAFGRKIMTKLNYILSIIDDTYDAYGTLEELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 79 - protein, 548 aa, Artificial Sequence
  CVS mutants V102, V103 and V10
MSSGETFRPTADFHPSLWRNHFLAGASDFKTVDHTATAERHEALKEEVRRMITDAEDAPIQKLRLIDEVQRLGVAYHFEKEIEDAIQALCPIHIDSDKADLHTVSLHFRLLRQQGIKISCDVFEAFKDDEGRFKSSLINDVQGMLSLYEAAYMAVRGEHILDEAIAFTTTHLASLVAQDHVTPRLAEQINHALYRPLRKTLPRLEARYIMSRIDSTSDDLVNKTLLNFAKLDFNILLDLHKEELNELTKWWADLDFTTKLPYARDRLVELYFWDLGTYLEPQYAFGRKIMTKLNYILSIIDDTYDAYGTLEELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 80 - protein, 548 aa, Artificial Sequence
  CVS mutants V105 and V106
MSSGETFRPTADFHPSLWRNHFLAGASDFKTVDHTATAERHEALKEEVRRMITDAEDAPIQKLRLIDEVQRLGVAYHFEKEIEDAIQALCPIHIDSDKADLHTVSLHFRLLRQQGIKISCDVFEAFKDDEGRFKSSLINDVQGMLSLYEAAYMAVRGEHILDEAIAFTTTHLASLVAQDHVTPRLAEQINHALYRPLRKTLPRLEARYIMSRIDSTSDDLVNKTLLNFAKLDFNILLDLHKEELNELTKWWADLDFTTKLPYARDRLVELYFWDLGTYNEPQYAFGRKIMTKLNYILSIIDDTYDAYGTLEELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 81 - protein, 548 aa, Artificial Sequence
  CVS mutant V107
MSSGETFRPTADFHPSLWRNHFLAGASDFKTVDHTATAERHEALKEEVRRMITDAEDAPIQKLRLIDEVQRLGVAYHFEKEIEDAIQALCPIHIDSDKADLHTVSLHFRLLRQQGIKISCDVFEAFKDDEGRFKSSLINDVQGMLSLYEAAYMAVRGEHILDEAIAFTTTHLASLVAQDHVTPRLAEQINHALYRPLRKTLPRLEARYIMSRIDSTSDDLVNKTLLNFAKLDFNILLDLHKEELNELTKWWADLDFTTKLPYARDRLVELYFWDLGTYFEWQYAFGRKIMTKLNYILSIIDDTYDAYGTLEELSLFTEAVARWNIEAVDMLPDYMKLIYRTLLDTFNEIKEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 82 - protein, 548 aa, Artificial Sequence
  CVS mutant V108
MSSGETFRPTADFHPSLWRNHFLAGASDFKTVDHTATAERHEALKEEVRRMITDAEDAPIQKLRLIDEVQRLGVAYHFEKEIEDAIQALCPIHIDSDKADLHTVSLHFRLLRQQGIKISCDVFEAFKDDEGRFKSSLINDVQGMLSLYEAAYMAVRGEHILDEAIAFTTTHLASLVAQDHVTPRLAEQINHALYRPLRKTLPRLEARYIMSRIDSTSDDLVNKTLLNFAKLDFNILLDLHKEELNELTKWWADLDFTTKLPYARDRLVELYFWDLGTYMEPQYAFGRKIMTKLNYILSIIDDTYDAYGTLEELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 83 - protein, 548 aa, Artificial Sequence
  CVS mutant V109
MSSGETFRPTADFHPSLWRNHFLAGASDFKTVDHTATAERHEALKEEVRRMITDAEDAPIQKLRLIDEVQRLGVAYHFEKEIEDAIQALCPIHIDSDKADLHTVSLHFRLLRQQGIKISCDVFEAFKDDEGRFKSSLINDVQGMLSLYEAAYMAVRGEHILDEAIAFTTTHLASLVAQDHVTPRLAEQINHALYRPLRKTLPRLEARYIMSRIDSTSDDLVNKTLLNFAKLDFNILLDLHKEELNELTKWWADLDFTTKLPYARDRLVELYFWDLGTYHEPQYAFGRKIMTKLNYILSIIDDTYDAYGTLEELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 84 - protein, 548 aa, Artificial Sequence
  CVS mutants V110 and V111
MSSGETFRPTADFHPSLWRNHFLAGASDFKTVDHTATAERHEALKEEVRRMITDAEDAPIQKLRLIDEVQRLGVAYHFEKEIEDAIQALCPIHIDSDKADLHTVSLHFRLLRQQGIKISCDVFEAFKDDEGRFKSSLINDVQGMLSLYEAAYMAVRGEHILDEAIAFTTTHLASLVAQDHVTPRLAEQINHALYRPLRKTLPRLEARYIMSRIDSTSDDLVNKTLLNFAKLDFNILLDLHKEELNELTKWWADLDFTTKLPYARDRLVELYFWDLGTYCEPQYAFGRKIMTKLNYILSIIDDTYDAYGTLEELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 85 - protein, 548 aa, Artificial Sequence
  CVS mutant V112
MSSGETFRPTADFHPSLWRNHFLAGASDFKTVDHTATAERHEALKEEVRRMITDAEDAPIQKLRLIDEVQRLGVAYHFEKEIEDAIQALCPIHIDSDKADLHTVSLHFRLLRQQGIKISCDVFEAFKDDEGRFKSSLINDVQGMLSLYEAAYMAVRGEHILDEAIAFTTTHLASLVAQDHVTPRLAEQINHALYRPLRKTLPRLEARYIMSRIDSTSDDLVNKTLLNFAKLDFNILLDLHKEELNELTKWWADLDFTTKLPYARDRLVELYFWDLGTYFEWQYAFGRKIMTKLNYILSIIDDTYDAYGTLEELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 86 - protein, 548 aa, Artificial Sequence
  CVS mutant V113
MSSGETFRPTADFHPSLWRNHFLAGASDFKTVDHTATAERHEALKEEVRRMITDAEDAPIQKLRLIDEVQRLGVAYHFEKEIEDAIQALCPIHIDSDKADLHTVSLHFRLLRQQGIKISCDVFEAFKDDEGRFKSSLINDVQGMLSLYEAAYMAVRGEHILDEAIAFTTTHLASLVAQDHVTPRLAEQINHALYRPLRKTLPRLEARYIMSRIDSTSDDLVNKTLLNFAKLDFNILLDLHKEELNELTKWWADLDFTTKLPYARDRLVELYFWDLGTYAEPQYAFGRKIMTKLNYILSIIDDTYDAYGTLEELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 87 - protein, 548 aa, Artificial Sequence
  CVS mutants V114 and V115
MSSGETFRPTADFHPSLWRNHFLAGASDFKTVDHTATAERHEALKEEVRRMITDAEDAPIQKLRLIDEVQRLGVAYHFEKEIEDAIQALCPIHIDSDKADLHTVSLHFRLLRQQGIKISCDVFEAFKDDEGRFKSSLINDVQGMLSLYEAAYMAVRGEHILDEAIAFTTTHLASLVAQDHVTPRLAEQINHALYRPLRKTLPRLEARYIMSRIDSTSDDLVNKTLLNFAKLDFNILLDLHKEELNELTKWWADLDFTTKLPYARDRLVELYFWDLGTYGEPQYAFGRKIMTKLNYILSIIDDTYDAYGTLEELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 88 - protein, 548 aa, Artificial Sequence
  CVS mutant V117
MSSGETFRPTADFHPSLWRNHFLAGASDFKTVDHTATAERHEALKEEVRRMITDAEDAPIQKLRLIDEVQRLGVAYHFEKEIEDAIQALCPIHIDSDKADLHTVSLHFRLLRQQGIKISCDVFEAFKDDEGRFKSSLINDVQGMLSLYEAAYMAVRGEHILDEAIAFTTTHLASLVAQDHVTPRLAEQINHALYRPLRKTLPRLEARYIMSRIDSTSDDLVNKTLLNFAKLDFNILLDLHKEELNELTKWWADLDFTTKLPYARDRLVELYFWDLGTYWEPQYAFGRKIMTKLNYILSIIDDTYDAYGTLEELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 89 - protein, 548 aa, Artificial Sequence
  CVS mutant V118
MSSGETFRPTADFHPSLWRNHFLAGASDFKTVDHTATAERHEALKEEVRRMITDAEDAPIQKLRLIDEVQRLGVAYHFEKEIEDAIQALCPIHIDSDKADLHTVSLHFRLLRQQGIKISCDVFEAFKDDEGRFKSSLINDVQGMLSLYEAAYMAVRGEHILDEAIAFTTTHLASLVAQDHVTPRLAEQINHALYRPLRKTLPRLEARYIMSRIDSTSDDLVNKTLLNFAKLDFNILLDLHKEELNELTKWWADLDFTTKLPYARDRLVELYFWDLGTYFEHQYAFGRKIMTKLNYILSIIDDTYDAYGTLEELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 90 - protein, 548 aa, Artificial Sequence
  CVS mutants V119 and V120
MSSGETFRPTADFHPSLWRNHFLAGASDFKTVDHTATAERHEALKEEVRRMITDAEDAPIQKLRLIDEVQRLGVAYHFEKEIEDAIQALCPIHIDSDKADLHTVSLHFRLLRQQGIKISCDVFEAFKDDEGRFKSSLINDVQGMLSLYEAAYMAVRGEHILDEAIAFTTTHLASLVAQDHVTPRLAEQINHALYRPLRKTLPRLEARYIMSRIDSTSDDLVNKTLLNFAKLDFNILLDLHKEELNELTKWWADLDFTTKLPYARDRLVELYFWDLGTYFEKQYAFGRKIMTKLNYILSIIDDTYDAYGTLEELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 91 - protein, 548 aa, Artificial Sequence
  CVS mutants V121, V122 and V123
MSSGETFRPTADFHPSLWRNHFLAGASDFKTVDHTATAERHEALKEEVRRMITDAEDAPIQKLRLIDEVQRLGVAYHFEKEIEDAIQALCPIHIDSDKADLHTVSLHFRLLRQQGIKISCDVFEAFKDDEGRFKSSLINDVQGMLSLYEAAYMAVRGEHILDEAIAFTTTHLASLVAQDHVTPRLAEQINHALYRPLRKTLPRLEARYIMSRIDSTSDDLVNKTLLNFAKLDFNILLDLHKEELNELTKWWADLDFTTKLPYARDRLVELYFWDLGTYFEAQYAFGRKIMTKLNYILSIIDDTYDAYGTLEELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 92 - protein, 548 aa, Artificial Sequence
  CVS mutants V124 and V125
MSSGETFRPTADFHPSLWRNHFLAGASDFKTVDHTATAERHEALKEEVRRMITDAEDAPIQKLRLIDEVQRLGVAYHFEKEIEDAIQALCPIHIDSDKADLHTVSLHFRLLRQQGIKISCDVFEAFKDDEGRFKSSLINDVQGMLSLYEAAYMAVRGEHILDEAIAFTTTHLASLVAQDHVTPRLAEQINHALYRPLRKTLPRLEARYIMSRIDSTSDDLVNKTLLNFAKLDFNILLDLHKEELNELTKWWADLDFTTKLPYARDRLVELYFWDLGTYFESQYAFGRKIMTKLNYILSIIDDTYDAYGTLEELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 93 - protein, 548 aa, Artificial Sequence
  CVS mutant V126
MSSGETFRPTADFHPSLWRNHFLAGASDFKTVDHTATAERHEALKEEVRRMITDAEDAPIQKLRLIDEVQRLGVAYHFEKEIEDAIQALCPIHIDSDKADLHTVSLHFRLLRQQGIKISCDVFEAFKDDEGRFKSSLINDVQGMLSLYEAAYMAVRGEHILDEAIAFTTTHLASLVAQDHVTPRLAEQINHALYRPLRKTLPRLEARYIMSRIDSTSDDLVNKTLLNFAKLDFNILLDLHKEELNELTKWWADLDFTTKLPYARDRLVELYFWDLGTYFEWQFAFGRKIMTKLNYILSIIDDTYDAYGTLEELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 94 - protein, 548 aa, Artificial Sequence
  CVS mutant V127
MSSGETFRPTADFHPSLWRNHFLAGASDFKTVDHTATAERHEALKEEVRRMITDAEDAPIQKLRLIDEVQRLGVAYHFEKEIEDAIQALCPIHIDSDKADLHTVSLHFRLLRQQGIKISCDVFEAFKDDEGRFKSSLINDVQGMLSLYEAAYMAVRGEHILDEAIAFTTTHLASLVAQDHVTPRLAEQINHALYRPLRKTLPRLEARYIMSRIDSTSDDLVNKTLLNFAKLDFNILLDLHKEELNELTKWWADLDFTTKLPYARDRLVELYFWDLGTYFEAPYAFGRKIMTKLNYILSIIDDTYDAYGTLEELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 95 - protein, 548 aa, Artificial Sequence
  CVS mutant V128
MSSGETFRPTADFHPSLWRNHFLAGASDFKTVDHTATAERHEALKEEVRRMITDAEDAPIQKLRLIDEVQRLGVAYHFEKEIEDAIQALCPIHIDSDKADLHTVSLHFRLLRQQGIKISCDVFEAFKDDEGRFKSSLINDVQGMLSLYEAAYMAVRGEHILDEAIAFTTTHLASLVAQDHVTPRLAEQINHALYRPLRKTLPRLEARYIMSRIDSTSDDLVNKTLLNFAKLDFNILLDLHKEELNELTKWWADLDFTTKLPYARDRLVELYFWDLGTYFEPQYAFGRKIMTKLNYILSIIDDTYDAYGTLEELSLLTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 96 - protein, 548 aa, Artificial Sequence
  CVS mutant V129
MSSGETFRPTADFHPSLWRNHFLAGASDFKTVDHTATAERHEALKEEVRRMITDAEDAPIQKLRLIDEVQRLGVAYHFEKEIEDAIQALCPIHIDSDKADLHTVSLHFRLLRQQGIKISCDVFEAFKDDEGRFKSSLINDVQGMLSLYEAAYMAVRGEHILDEAIAFTTTHLASLVAQDHVTPRLAEQINHALYRPLRKTLPRLEARYIMSRIDSTSDDLVNKTLLNFAKLDFNILLDLHKEELNELTKWWADLDFTTKLPYARDRLVELYFWDLGTYFLPQYAFGRKIMTKLNYILSIIDDTYDAYGTLEELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 97 - protein, 548 aa, Artificial Sequence
  CVS mutant V131
MSSGETFRPTADFHPSLWRNHFLAGASDFKTVDHTATAERHEALKEEVRRMITDAEDAPIQKLRLIDEVQRLGVAYHFEKEIEDAIQALCPIHIDSDKADLHTVSLHFRLLRQQGIKISCDVFEAFKDDEGRFKSSLINDVQGMLSLYEAAYMAVRGEHILDEAIAFTTTHLASLVAQDHVTPRLAEQINHALYRPLRKTLPRLEARYIMSRIDSTSDDLVNKTLLNFAKLDFNILLDLHKEELNELTKWWADLDFTTKLPYARDRLVELYFWDLGTYFELQYAFGRKIMTKLNYILSIIDDTYDAYGTLEELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 98 - protein, 548 aa, Artificial Sequence
  CVS mutant V135
MSSGETFRPTADFHPSLWRNHFLAGASDFKTVDHTATAERHEALKEEVRRMITDAEDAPIQKLRLIDEVQRLGVAYHFEKEIEDAIQALCPIHIDSDKADLHTVSLHFRLLRQQGIKISCDVFEAFKDDEGRFKSSLINDVQGMLSLYEAAYMAVRGEHILDEAIAFTTTHLASLVAQDHVTPRLAEQINHALYRPLRKTLPRLEARYIMSRIDSTSDDLVNKTLLNFAKLDFNILLDLHKEELNELTKWWADLDFTTKLPYARDRLVELYFWDLGTYFEYQYAFGRKIMTKLNYILSIIDDTYDAYGTLEELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 99 - protein, 548 aa, Artificial Sequence
  CVS mutant V137
MSSGETFRPTADFHPSLWRNHFLAGASDFKTVDHTATAERHEALKEEVRRMITDAEDAPIQKLRLIDEVQRLGVAYHFEKEIEDAIQALCPIHIDSDKADLHTVSLHFRLLRQQGIKISCDVFEAFKDDEGRFKSSLINDVQGMLSLYEAAYMAVRGEHILDEAIAFTTTHLASLVAQDHVTPRLAEQINHALYRPLRKTLPRLEARYIMSRIDSTSDDLVNKTLLNFAKLDFNILLDLHKEELNELTKWWADLDFTTKLPYARDRLVELYFWDLGTYFELPYAFGRKIMTKLNYILSIIDDTYDAYGTLEELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 100 - protein, 548 aa, Artificial Sequence; identical to SEQ ID NO: 41
  CVS mutants V138, V139 and V140

SEQ ID NO: 101 - protein, 548 aa, Artificial Sequence
  CVS mutants V141 and V142
MSSGETFRPTADFHPSLWRNHFLAGASDFKTVDHTATAERHEALKEEVRRMITDAEDAPIQKLRLIDEVQRLGVAYHFEKEIEDAIQALCPIHIDSDKADLHTVSLHFRLLRQQGIKISCDVFEAFKDDEGRFKSSLINDVQGMLSLYEAAYMAVRGEHILDEAIAFTTTHLASLVAQDHVTPRLAEQINHALYRPLRKTLPRLEARYIMSRIDSTSDDLVNKTLLNFAKLDFNILLDLHKEELNELTKWWADLDFTTKLPYARDRLVELYFWDLGTYFEPAYAFGRKIMTKLNYILSIIDDTYDAYGTLEELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 102 - protein, 548 aa, Artificial Sequence
  CVS mutant V143
MSSGETFRPTADFHPSLWRNHFLAGASDFKTVDHTATAERHEALKEEVRRMITDAEDAPIQKLRLIDEVQRLGVAYHFEKEIEDAIQALCPIHIDSDKADLHTVSLHFRLLRQQGIKISCDVFEAFKDDEGRFKSSLINDVQGMLSLYEAAYMAVRGEHILDEAIAFTTTHLASLVAQDHVTPRLAEQINHALYRPLRKTLPRLEARYIMSRIDSTSDDLVNKTLLNFAKLDFNILLDLHKEELNELTKWWADLDFTTKLPYARDRLVELYFWDLGTYFEPIYAFGRKIMTKLNYILSIIDDTYDAYGTLEELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 103 - protein, 548 aa, Artificial Sequence
  CVS mutants V144, V145 and V178
MSSGETFRPTADFHPSLWRNHFLAGASDFKTVDHTATAERHEALKEEVRRMITDAEDAPIQKLRLIDEVQRLGVAYHFEKEIEDAIQALCPIHIDSDKADLHTVSLHFRLLRQQGIKISCDVFEAFKDDEGRFKSSLINDVQGMLSLYEAAYMAVRGEHILDEAIAFTTTHLASLVAQDHVTPRLAEQINHALYRPLRKTLPRLEARYIMSRIDSTSDDLVNKTLLNFAKLDFNILLDLHKEELNELTKWWADLDFTTKLPYARDRLVELYFWDLGTYFEPRYAFGRKIMTKLNYILSIIDDTYDAYGTLEELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 104 - protein, 548 aa, Artificial Sequence
  CVS mutant V146
MSSGETFRPTADFHPSLWRNHFLAGASDFKTVDHTATAERHEALKEEVRRMITDAEDAPIQKLRLIDEVQRLGVAYHFEKEIEDAIQALCPIHIDSDKADLHTVSLHFRLLRQQGIKISCDVFEAFKDDEGRFKSSLINDVQGMLSLYEAAYMAVRGEHILDEAIAFTTTHLASLVAQDHVTPRLAEQINHALYRPLRKTLPRLEARYIMSRIDSTSDDLVNKTLLNFAKLDFNILLDLHKEELNELTKWWADLDFTTKLPYARDRLVELYFWDLGTYFEPYYAFGRKIMTKLNYILSIIDDTYDAYGTLEELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 105 - protein, 548 aa, Artificial Sequence; identical to SEQ ID NO: 45
  CVS mutants V147 and V148

SEQ ID NO: 106 - protein, 548 aa, Artificial Sequence
  CVS mutant V149
MSSGETFRPTADFHPSLWRNHFLAGASDFKTVDHTATAERHEALKEEVRRMITDAEDAPIQKLRLIDEVQRLGVAYHFEKEIEDAIQALCPIHIDSDKADLHTVSLHFRLLRQQGIKISCDVFEAFKDDEGRFKSSLINDVQGMLSLYEAAYMAVRGEHILDEAIAFTTTHLASLVAQDHVTPRLAEQINHALYRPLRKTLPRLEARYIMSRIDSTSDDLVNKTLLNFAKLDFNILLDLHKEELNELTKWWADLDFTTKLPYARDRLVELYFWDLGTYFEPGYAFGRKIMTKLNYILSIIDDTYDAYGTLEELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 107 - protein, 548 aa, Artificial Sequence
  CVS mutant V150
MSSGETFRPTADFHPSLWRNHFLAGASDFKTVDHTATAERHEALKEEVRRMITDAEDAPIQKLRLIDEVQRLGVAYHFEKEIEDAIQALCPIHIDSDKADLHTVSLHFRLLRQQGIKISCDVFEAFKDDEGRFKSSLINDVQGMLSLYEAAYMAVRGEHILDEAIAFTTTHLASLVAQDHVTPRLAEQINHALYRPLRKTLPRLEARYIMSRIDSTSDDLVNKTLLNFAKLDFNILLDLHKEELNELTKWWADLDFTTKLPYARDRLVELYFWDLGTYFEPGYAFGRKIMTKLNYILSIIDDTYDAYGTLEELSLFTEAVARWSIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 108 - protein, 548 aa, Artificial Sequence
  CVS mutant V151
MSSGETFRPTADFHPSLWRNHFLAGASDFKTVDHTATAERHEALKEEVRRMITDAEDAPIQKLRLIDEVQRLGVAYHFEKEIEDAIQALCPIHIDSDKADLHTVSLHFRLLRQQGIKISCDVFEAFKDDEGRFKSSLINDVQGMLSLYEAAYMAVRGEHILDEAIAFTTTHLASLVAQDHVTPRLAEQINHALYRPLRKTLPRLEARYIMSRIDSTSDDLVNKTLLNFAKLDFNILLDLHKEELNELTKWWADLDFTTKLPYARDRLVELYFWDLGTYFEPAYAFGRKIMTKLNYILSIIDDTYDAYGTLEELSLFTEAVARWNIEAVDMLPDYMKLIYRTLLDTFSEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 109 - protein, 548 aa, Artificial Sequence
  CVS mutant V152
MSSGETFRPTADFHPSLWRNHFLAGASDFKTVDHTATAERHEALKEEVRRMITDAEDAPIQKLRLIDEVQRLGVAYHFEKEIEDAIQALCPIHIDSDKADLHTVSLHFRLLRQQGIKISCDVFEAFKDDEGRFKSSLINDVQGMLSLYEAAYMAVRGEHILDEAIAFTTTHLASLVAQDHVTPRLAEQINHALYRPLRKTLPRLEARYIMSRIDSTSDDLVNKTLLNFAKLDFNILLDLHKEELNELTKWWADLDFTTKLPYARDRLVELYFWDLGTYFEPWYAFGRKIMTKLNYILSIIDDTYDAYGTLEELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 110 - protein, 548 aa, Artificial Sequence
  CVS mutants V153 and V154
MSSGETFRPTADFHPSLWRNHFLAGASDFKTVDHTATAERHEALKEEVRRMITDAEDAPIQKLRLIDEVQRLGVAYHFEKEIEDAIQALCPIHIDSDKADLHTVSLHFRLLRQQGIKISCDVFEAFKDDEGRFKSSLINDVQGMLSLYEAAYMAVRGEHILDEAIAFTTTHLASLVAQDHVTPRLAEQINHALYRPLRKTLPRLEARYIMSRIDSTSDDLVNKTLLNFAKLDFNILLDLHKEELNELTKWWADLDFTTKLPYARDRLVELYFWDLGTYFEPPYAFGRKIMTKLNYILSIIDDTYDAYGTLEELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 111 - protein, 548 aa, Artificial Sequence
  CVS mutant V155
MSSGETFRPTADFHPSLWRNHFLAGASDFKTVDHTATAERHEALKEEVRRMITDAEDAPIQKLRLIDEVQRLGVAYHFEKEIEDAIQALCPIHIDSDKADLHTVSLHFRLLRQQGIKISCDVFEAFKDDEGRFKSSLINDVQGMLSLYEAAYMAVRGEHILDEAIAFTTTHLASLVAQDHVTPRLAEQINHALYRPLRKTLPRLEARYIMSRIDSTSDDLVNKTLLNFAKLDFNILLDLHKEELNELTKWWADLDFTTKLPYARDRLVELYFWDLGTYFEPEYAFGRKIMTKLNYILSIIDDTYDAYGTLEELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 112 - protein, 548 aa, Artificial Sequence
  CVS mutant V156
MSSGETFRPTADFHPSLWRNHFLAGASDFKTVDHTATAERHEALKEEVRRMITDAEDAPIQKLRLIDEVQRLGVAYHFEKEIEDAIQALCPIHIDSDKADLHTVSLHFRLLRQQGIKISCDVFEAFKDDEGRFKSSLINDVQGMLSLYEAAYMAVRGEHILDEAIAFTTTHLASLVAQDHVTPRLAEQINHALYRPLRKTLPRLEARYIMSRIDSTSDDLVNKTLLNFAKLDFNILLDLHKEELNELTKWWADLDFTTKLPYARDRLVELYFWDLGTYFEPQYTFGRKIMTKLNYILSIIDDTYDAHGTLEELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 113 - protein, 548 aa, Artificial Sequence
  CVS mutant V157
MSSGETFRPTADFHPSLWRNHFLAGASDFKTVDHTATAERHEALKEEVRRMITDAEDAPIQKLRLIDEVQRLGVAYHFEKEIEDAIQALCPIHIDSDKADLHTVSLHFRLLRQQGIKISCDVFEAFKDDEGRFKSSLINDVQGMLSLYEAAYMAVRGEHILDEAIAFTTTHLASLVAQDHVTPRLAEQINHALYRPLRKTLPRLEARYIMSRIDSTSDDLVNKTLLNFAKLDFNILLDLHKEELNELTKWWADLDFTTKLPYARDRLVELYFWDLGTYFEPQYGFGRKIMTKLNYILSIIDDTYDAYGTLEELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 114 - protein, 548 aa, Artificial Sequence
  CVS mutants V158 and V159
MSSGETFRPTADFHPSLWRNHFLAGASDFKTVDHTATAERHEALKEEVRRMITDAEDAPIQKLRLIDEVQRLGVAYHFEKEIEDAIQALCPIHIDSDKADLHTVSLHFRLLRQQGIKISCDVFEAFKDDEGRFKSSLINDVQGMLSLYEAAYMAVRGEHILDEAIAFTTTHLASLVAQDHVTPRLAEQINHALYRPLRKTLPRLEARYIMSRIDSTSDDLVNKTLLNFAKLDFNILLDLHKEELNELTKWWADLDFTTKLPYARDRLVELYFWDLGTYFEPQYPFGRKIMTKLNYILSIIDDTYDAYGTLEELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 115 - protein, 548 aa, Artificial Sequence; identical to SEQ ID NO: 113
  CVS mutant V160

SEQ ID NO: 116 - protein, 548 aa, Artificial Sequence
  CVS mutant V161
MSSGETFRPTADFHPSLWRNHFLAGASDFKTVDHTATAERHEALKEEVRRMITDAEDAPIQKLRLIDEVQRLGVAYHFEKEIEDAIQALCPIHIDSDKADLHTVSLHFRLLRQQGIKISCDVFEAFKDDEGRFKSSLINDVQGMLSLYEAAYMAVRGEHILDEAIAFTTTHLASLVAQDHVTPRLAEQINHALYRPLRKTLPRLEARYIMSRIDSTSDDLVNKTLLNFAKLDFNILLDLHKEELNELTKWWADLDFTTKLPYARDRLVELYFWDLGTYFEPQYVFGRKIMTKLNYILSIIDDTYDAYGTLEELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 117 - protein, 548 aa, Artificial Sequence
  CVS mutant V162
  VARIANT 301: Xaa = Asp or Glu
  VARIANT 358: Xaa = Ile, Thr, Lys or Arg
  VARIANT 378: Xaa = Phe, Leu, Ile or Val
MSSGETFRPTADFHPSLWRNHFLAGASDFKTVDHTATAERHEALKEEVRRMITDAEDAPIQKLRLIDEVQRLGVAYHFEKEIEDAIQALCPIHIDSDKADLHTVSLHFRLLRQQGIKISCDVFEAFKDDEGRFKSSLINDVQGMLSLYEAAYMAVRGEHILDEAIAFTTTHLASLVAQDHVTPRLAEQINHALYRPLRKTLPRLEARYIMSRIDSTSDDLVNKTLLNFAKLDFNILLDLHKEELNELTKWWADLDFTTKLPYARDRLVELYFWDLGTYFEPQYGFGRKIMTKLNYILSIIXDTYDAYGTLEELSLFTEAVARWNIEAVDMLPDYMKLIYRTLLDTFNEIEEDMAKQGXSHCVRYAKEEIQKVIGAYYXQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 118 - protein, 548 aa, Artificial Sequence
  CVS mutants V163 and V164
MSSGETFRPTADFHPSLWRNHFLAGASDFKTVDHTATAERHEALKEEVRRMITDAEDAPIQKLRLIDEVQRLGVAYHFEKEIEDAIQALCPIHIDSDKADLHTVSLHFRLLRQQGIKISCDVFEAFKDDEGRFKSSLINDVQGMLSLYEAAYMAVRGEHILDEAIAFTTTHLASLVAQDHVTPRLAEQINHALYRPLRKTLPRLEARYIMSRIDSTSDDLVNKTLLNFAKLDFNILLDLHKEELNELTKWWADLDFTTKLPYARDRLVELYFWDLGTYFEPQYRFGRKIMTKLNYILSIIDDTYDAYGTLEELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 119 - protein, 548 aa, Artificial Sequence
  CVS mutants V165 and V166
MSSGETFRPTADFHPSLWRNHFLAGASDFKTVDHTATAERHEALKEEVRRMITDAEDAPIQKLRLIDEVQRLGVAYHFEKEIEDAIQALCPIHIDSDKADLHTVSLHFRLLRQQGIKISCDVFEAFKDDEGRFKSSLINDVQGMLSLYEAAYMAVRGEHILDEAIAFTTTHLASLVAQDHVTPRLAEQINHALYRPLRKTLPRLEARYIMSRIDSTSDDLVNKTLLNFAKLDFNILLDLHKEELNELTKWWADLDFTTKLPYARDRLVELYFWDLGTYFEPQYDFGRKIMTKLNYILSIIDDTYDAYGTLEELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 120 - protein, 548 aa, Artificial Sequence
  CVS mutant V167
MSSGETFRPTADFHPSLWRNHFLAGASDFKTVDHTATAERHEALKEEVRRMITDAEDAPIQKLRLIDEVQRLGVAYHFEKEIEDAIQALCPIHIDSDKADLHTVSLHFRLLRQQGIKISCDVFEAFKDDEGRFKSSLINDVQGMLSLYEAAYMAVRGEHILDEAIAFTTTHLASLVAQDHVTPRLAEQINHALYRPLRKTLPRLEARYIMSRIDSTSDDLVNKTLLNFAKLDFNILLDLHKEELNELTKWWADLDFTTKLPYARDRLVELYFWDLGTYFEPQYEFGRKIMTKLNYILSIIDDTYDAYGTLEELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 121 - protein, 548 aa, Artificial Sequence
  CVS mutant V168
MSSGETFRPTADFHPSLWRNHFLAGASDFKTVDHTATAERHEALKEEVRRMITDAEDAPIQKLRLIDEVQRLGVAYHFEKEIEDAIQALCPIHIDSDKADLHTVSLHFRLLRQQGIKISCDVFEAFKDDEGRFKSSLINDVQGMLSLYEAAYMAVRGEHILDEAIAFTTTHLASLVAQDHVTPRLAEQINHALYRPLRKTLPRLEARYIMSRIDSTSDDLVNKTLLNFAKLDFNILLDLHKEELNELTKWWADLDFTTKLPYARDRLVELYFWDLGTYFEPQNSFGRKIMTKLNYILSIIDDTYDAYGTLEELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 122 - protein, 548 aa, Artificial Sequence
  CVS mutant V169
MSSGETFRPTADFHPSLWRNHFLAGASDFKTVDHTATAERHEALKEEVRRMITDAEDAPIQKLRLIDEVQRLGVAYHFEKEIEDAIQALCPIHIDSDKADLHTVSLHFRLLRQQGIKISCDVFEAFKDDEGRFKSSLINDVQGMLSLYEAAYMAVRGEHILDEAIAFTTTHLASLVAQDHVTPRLAEQINHALYRPLRKTLPRLEARYIMSRIDSTSDDLVNKTLLNFAKLDFNILLDLHKEELNELTKWWADLDFTTKLPYARDRLVELYFWDLGTYFEPQYHFGRKIMTKLNYILSIIDDTYDAYGTLEELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 123 - protein, 548 aa, Artificial Sequence
  CVS mutant V170
MSSGETFRPTADFHPSLWRNHFLAGASDFKTVDHTATAERHEALKEEVRRMITDAEDAPIQKLRLIDEVQRLGVAYHFEKEIEDAIQALCPIHIDSDKADLHTVSLHFRLLRQQGIKISCDVFEAFKDDEGRFKSSLINDVQGMLSLYEAAYMAVRGEHILDEAIAFTTTHLASLVAQDHVTPRLAEQINHALYRPLRKTLPRLEARYIMSRIDSTSDDLVNKTLLNFAKLDFNILLDLHKEELNELTKWWADLDFTTKLPYARDRLVELYFWDLGTYFEPQYKFGRKIMTKLNYILSIIDDTYDAYGTLEELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 124 - protein, 548 aa, Artificial Sequence
  CVS mutant V171
MSSGETFRPTADFHPSLWRNHFLAGASDFKTVDHTATAERHEALKEEVRRMITDAEDAPIQKLRLIDEVQRLGVAYHFEKEIEDAIQALCPIHIDSDKADLHTVSLHFRLLRQQGIKISCDVFEAFKDDEGRFKSSLINDVQGMLSLYEAAYMAVRGEHILDEAIAFTTTHLASLVAQDHVTPRLAEQINHALYRPLRKTLPRLEARYIMSRIDSTSDDLVNKTLLNFAKLDFNILLDLHKEELNELTKWWADLDFTTKLPYARDRLVELYFWDLGTYFEPQYIFGRKIMTKLNYILSIIDDTYDAYGTLEELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 125 - protein, 548 aa, Artificial Sequence
  CVS mutant V172
  VARIANT 342: Xaa = L, S, W, P, Q, R, M, T, K, V, A, E or G
MSSGETFRPTADFHPSLWRNHFLAGASDFKTVDHTATAERHEALKEEVRRMITDAEDAPIQKLRLIDEVQRLGVAYHFEKEIEDAIQALCPIHIDSDKADLHTVSLHFRLLRQQGIKISCDVFEAFKDDEGRFKSSLINDVQGMLSLYEAAYMAVRGEHILDEAIAFTTTHLASLVAQDHVTPRLAEQINHALYRPLRKTLPRLEARYIMSRIDSTSDDLVNKTLLNFAKLDFNILLDLHKEELNELTKWWADLDFTTKLPYARDRLVELYFWDLGTYFEPQYWFGRKIMTKLNYILSIIDDTYDAYGTLEELSLFTEAVARWNIEAVDMLPDYMKLIYRTXLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 126 - protein, 548 aa, Artificial Sequence
  CVS mutant V173
MSSGETFRPTADFHPSLWRNHFLAGASDFKTVDHTATAERHEALKEEVRRMITDAEDAPIQKLRLIDEVQRLGVAYHFEKEIEDAIQALCPIHIDSDKADLHTVSLHFRLLRQQGIKISCDVFEAFKDDEGRFKSSLINDVQGMLSLYEAAYMAVRGEHILDEAIAFTTTHLASLVAQDHVTPRLAEQINHALYRPLRKTLPRLEARYIMSRIDSTSDDLVNKTLLNFAKLDFNILLDLHKEELNELTKWWADLDFTTKLPYARDRLVELYFWDLGTYFEPQYTFGRKIMTKLNYILSIIDDTYDAYGTLEELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 127 - protein, 548 aa, Artificial Sequence
  CVS mutant V174
MSSGETFRPTADFHPSLWRNHFLAGASDFKTVDHTATAERHEALKEEVRRMITDAEDAPIQKLRLIDEVQRLGVAYHFEKEIEDAIQALCPIHIDSDKADLHTVSLHFRLLRQQGIKISCDVFEAFKDDEGRFKSSLINDVQGMLSLYEAAYMAVRGEHILDEAIAFTTTHLASLVAQDHVTPRLAEQINHALYRPLRKTLPRLEARYIMSRIDSTSDDLVNKTLLNFAKLDFNILLDLHKEELNELTKWWADLDFTTKLPYARDRLVELYFWDLGTYFEPQYMFGRKIMTKLNYILSIIDDTYDAYGTLEELSLFTEAVARRNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 128 - DNA, 1647 bp, Artificial Sequence
  CVS V18
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttattttgaaccacaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 129 - DNA, 1647 bp, Artificial Sequence
  CVS V19
atgtcatctggtgaaacttttagaccaactgctgattttcatccatctttgtggagaaatcattttttgcaaggtgcatcagattttaagactgttgatcatacagctacaaatgaaagacatgaagctttgaaggaagaagttagaagaatgattactgatgcagaagatcaaccaattcaaaaattgagattgattgatgaagttcaaagattgggtgttgcttaccattttgaaaaagaaattgaagatgctattcaacaattgtgtccaattcatattgattctgataaagctgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttgggtacttattttgaaccacaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 130 - DNA, 1647 bp, Artificial Sequence
  CVS mutants V75 and V76
atgtcatctggtgaaacttttagaccaactgctgattttcatccatctttgtggagaaatcattttttgcaaggtgcatcagattttaagactgttgatcatacagctacaaatgaaagacatgaagctttgaaggaagaagttagaagaatgattactgatgcagaagatcaaccaattcaaaaattgagattgattgatgaagttcaaagattgggtgttgcttaccattttgaaaaagaaattgaagatgctattcaacaattgtgtccaattcatattgattctgataaagctgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttggggacttattttgaatcacaatacgcttttggtagaaaaatcatgactaaattgaactacattttgtccattattgatgatacctacgatgcttacggtactttggaagaatgcacgatgttcagtgaagctgttgctcgttggaacattgaagctgttgacatgttgccagattatatgcgaattatctacagaactttgttggatacattcaacgaaatagaagaggatatggctaaacaacggagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 131 - DNA, 1647 bp, Artificial Sequence
  CVS mutant V1
atgtcgtctggagaaacatttcgtcctactgcagatttccatcctagtttatggagaaaccatttcctcaaaggtgcttctgatttcaagacagttgatcatactgcaactcaagaacgacacgaggcactgaaagaagaggtaagaagaatgataacagatgctgaagataagcctgttcagaagttacgcttgattgatgaagtacaacgcctgggggtggcttatcactttgagaaagaaatagaagatgcaatacaaaaattatgtccaatctatattgacagtaatagagctgatctccacaccgtttcccttcattttcgattgcttaggcagcaaggaatcaagatttcatgtgatgtgtttgagaagttcaaagatgatgagggtagattcaagtcatcgttgataaacgatgttcaagggatgttaagtttgtacgaggcagcatacatggcagttcgcggagaacatatattagatgaagccattgctttcactaccactcacctgaagtcattggtagctcaggatcatgtaacccctaagcttgctgaacagataaatcatgctttataccgtcctcttcgtaaaaccctaccaagattagaggcgaggtattttatgtccatgatcgattcaacaagtgatcatttatacaataaaactctgctgaattttgcaaagttagattttaacatattgctagagctgcacaaggaggaactcaatgaattaacaaagtggtggaaagatttagacttcactacaaaactaccttatgcaagagacagattagtggagttatatttttgggatttagggacatacttcgagcctcaatatgcatttgggagaaagataatgacccaattaaattacatattatccatcatagatgatacttatgatgcgtatggtacacttgaagaactcagcctctttactgaagcagttcaaagatggaatattgaggccgtagatatgcttccagaatacatgaaattgatttacaggacactcttagatgcttttaatgaaattgaggaagatatggccaagcaaggaagatcacactgcgtacgttatgcaaaagaggagaatcaaaaagtaattggagcatactctgttcaagccaaatggttcagtgaaggttacgttccaacaattgaggagtatatgcctattgcactaacaagttgtgcttacacattcgtcataacaaattccttccttggcatgggtgattttgcaactaaagaggtttttgaatggatctccaataaccctaaggttgtaaaggcagcatcagttatctgcagactcatggatgacatgcaaggtcatgagtttgagcagaagagaggacatgttgcgtcagctattgaatgttacacgaagcagcatggtgtctataaggaagaggcaattaaaatgtttgaagaagaagttgcaaatgcatggaaagatattaacgaggagttgatgatgaagccaaccgtcgttgcccgaccactgctcgggacgattcttaatcttgctcgtgcaattgattttatttacaaagaggacgacggctatacgcattcttacctaattaaagatcaaattgcttctgtgctaggagaccacgttccattttga

SEQ ID NO: 132 - DNA, 1647 bp, Artificial Sequence
  CVS mutant V2
atgtcgtctggagaaacatttcgtcctactgcagatttccatcctagtttatggagaaaccatttcctcaaaggtgcttctgatttcaagacagttgatcatactgcaactcaagaacgacacgaggcactgaaagaagaggtaaggagaatgataacagatgctgaagataagcctgttcagaagttacgcttgattgatgaagtacaacgcctgggggtggcttatcactttgagaaagaaatagaagatgcaatacaaaaattatgtccaatctatattgacagtaatagagctgatctccacaccgtttcccttcattttcgattgcttaggcagcaaggaatcaagatttcatgtgatgtgtttgagaagttcaaagatgatgagggtagattcaagtcatcgttgataaacgatgttcaagggatgttaagtttgtacgaggcagcatacatggcagttcgcggagaacatatattagatgaagccattgctttcactaccactcacctgaagtcattggtagctcaggatcatgtaacccctaagcttgcggaacagataaatcatgctttataccgtcctcttcgtaaaaccctaccaagattagaggcgaggtattttatgtccatgatcaattcaacaagtgatcatttatacaataaaactctgctgaattttgcaaagttagattttaacatattgctagagctgcacaaggaggaactcaatgaattaacaaagtggtggaaagatttagacttcactacaaaactaccttatgcaagagacagattagtggagttatatttttgggatttagggacatacttcgagcctcaatatgcatttgggagaaagataatgacccaattaaattacatattatccatcatagatgatacttatgatgcgtatggtacacttgaagaactcagcctctttactgaagcagttcaaagatggaatattgaggccgtagatatgcttccagaatacatgaaattgatttacaggacactcttagatgcttttaatgaaattgaggaagatatggccaagcaaggaagatcacactgcgtacgttatgcaaaagaggagaatcaaaaagtaattggagcatactctgttcaagccaaatggttcagtgaaggttacgttccaacaattgaggagtatatgcctattgcactaacaagttgtgcttacagattcgtcataacaaattccttccttggcatgggtgattttgcaactaaagaggtttttgaatggatctccaataaccctaaggttgtaaaagcagcatcagttatctgcagactcatggatgacatgcaaggtcatgagtttgagcagaagagaggacatgttgcgtcagctattgaatgttacacgaagcagcatggtgtctctaaggaagaggcaattaaaatgtttgaagaagaagttgcaaatgcatggaaagatattaacgaggagttgatgatgaagccaaccgtcgttgcccgaccactgctcgggacgattcttaatcttgctcgtgcaattgattttatttacaaagaggacgacggctatacgcattcttacctaattaaagatcaaattgcttctgtgctaggagaccacgttccattttga

SEQ ID NO: 133 - DNA, 1647 bp, Artificial Sequence
  CVS mutant V3
atgtcgtctggagaaacatttcgtcctactgcagatttccatcctagtttatggagaaaccatttcctcaaaggtgcttctgatttcaagacagttgatcatactgctactcaagaacgacacgaggcactgaaagaagaggtaaggagaatgataacagatgctgaagataagcctgttcagaagttacgcttgattgatgaagtacaacgcctgggggtggcttatcactttgagaaagaaatagaagatgcaatacaaaaattatgtccaatctatattgacagtaatagagctgatctccacaccgtttcccttcattttcgattgcttaggcagcaaggaatcaagatttcatgtgatgtgtttgagaagttcaaagatgatgagggtagattcaagtcatcgttgataaacgatgttcaagggatgttaagtttgtacgaggcagcatacatggcagttcgcggagaacatatattagatgaagccattgctttcactaccactcacctgaagtcattggtagctcaggatcatgtaacccctaagcttgcggaacagataaatcatgctttataccgtcctcttcgtaaaaccctaccaagattagaggcgaggtattttatgtccatgatcaattcaacaagtgatcatttatacaataaaactctgctgaattttgcaaagttagattttaacatattgctagagctgcacaaggaggaactcaatgaattaacaaagtggtggaaagatttagacttcactacaaaactaccttatgcaagagacagattagtggagttatatttttgggatttagggacatacttcgagcctcaatatgcatttgggagaaagataatgacccaattaaattacatattatccatcatagatgatacttatgatgcgtatggtacacttgaagaactcagcctctttactgaagcagttcaaagatggaatattgaggccgtagatatgcttccagaatacatgaaattgatttacaggacactcttagatgtttttaatgaaattgaggaagatatggccaagcaaggaagatcacactgcgtacgttatgcaaaagaggagaatcaaaaagtaattggagcatactctgttcaagccaaatggttcagtgaaggttacgttccaacaattgaggagtatatgcctattgcactaacaagttgtgcttacacatttgtcataacaaattccttccttggcatgggtgattttgcaactaaagaggtttttgaatggatctccaataaccctaaggttgtaaaagcagcatcagttatctgcagactcatggatgacatgcaaggtcatgagtttgagcagaagagaggacatgttgcgtcagctattgaatgttacacgaagcagcatggtgtctctaaggaagaggcaattaaaatgtttgaagaagaagttgcaaatgcatggaaagatattaacgaggagttgatgatgaagccaaccgtcgttgcccgaccactgctcgggacgattcttaatcttgctcgtgcaattgattttatttacaaagaggacgacggctatacgcattcttacctaattaaagagcaaattgcatctgtgctaggagaccacgttccattttga

SEQ ID NO: 134 - DNA, 1647 bp, Artificial Sequence
  CVS mutant V4
atgtcgtctggagaaacatttcgtcctactgcagatttccatcctagtttatggagaaaccatttcctcaaaggtgcttctgatttcaagacagttgatcatactgcaactcaagaacgacacgaggcactgaaagaagaggtaaggagaatgataacagatgctgaagataagcctgttcagaagttacgcttgattgatgaagtacaacgcctgggggtggcttatcactttgagaaagaaatagaagatgcaatacaaaaattatgtccaatctatattgacagtaatagagctgatctccacaccgtttcccttcattttcgattgcttaggcagcaaggaatcaagatttcatgtgatgtgtttgagaagttcaaagatgatgagggtagattcaagtcatcgttgataaacgatgttcaagggatgttaagtttgtacgaggcagcatacatggcagttcgcggagaacatatattagatgaagccattgctttcactaccactcacctgaagtcattggtagctcaggatcatgtaacccctaagcttgcggaacagataaatcatgctttataccgtcctcttcgtaaaaccctaccaagattagaggcgaggtattttatgtccatgatcaattcaacaagtgatcatttatgcaataaaactctgctgaattttgcaaagttagattttaacatattgctagagctgcacaaggaggaactcaatgaattaacaaagtggtggaaagatttagacttcactacaaaactaccttatgcaagagacagattagtggagttatatttttgggatttagggacatacttcgagcctcaatatgcatttgggagaaagataatgacccaattaaattacatattatccatcatagatgatacttatgatgcgtatggtacacttgaagaactcagcctctttactgaagcagttcaaagatggaatattgaggccgtagatatgcttccagaatacatgaaattgatttacaggacactcttagatgcttttaatgaaattgaggaagatatggccaagcaaggaagatcacactgcgtacgttatgcaaaagaggagaatcaaaaagtaattggagcatactctgttcaagccaaatggttcagtgaaggttacgttccaacaattgaggagtatatgcctattgcactaacaagttgtgcttacacattcgtcataacaaattccttccttggcatgggtgattttgcaactaaagaggtttttgaatggatctccaataaccctaaggttgtaaaagcagcatcagttatctgcagactcatggatgacatgcaaggtcatgagtttgagcagaagagaggacatgttgcgtcagctattgaatgttacacgaagcagcatggtgtctctaaggaagaggcaattaaaatgtttgaagaagaagttgcaaatgcatggaaagatattaacgaggagttgatgatgaagccaaccgtcgttgcccgaccactgctcgggacgattcttaatcttgctcgtgcaattgattttatttacaaagaggacgacggctatacgcattcttacctaattaaagatcaaattgcttctgtgctgggagaccacgttccattttga

SEQ ID NO: 135 - DNA, 1647 bp, Artificial Sequence
  CVS mutant V5
atgtcgtctggagaaacatttcgtcctactgcagatttccatcctagtttatggagaaaccatttcctcaaaggtgcttctgatttcaagacagttgatcatactgcaactcaagaacgacacgaggcactgaaagaagaggtaaggagaatgataacagatgctgaagataagcctgttcagaagttacgcttgattgatgaagtacaacgcctgggggtggcttatcactttgagaaagaaatagaagatgcaatacaaaaattatgtccaatctatattgacagtaatagagctgatctccacaccgtttcccttcattttcgattgcttaggcagcaaggaatcaagatttcatgtgatgtgtttgagaagttcaaagatgatgagggtagattcaagtcatcgttgataaacgatgttcaagggatgttaagtttgtacgaggcagcatacatggcagttcgcggagaacatatattagatgaagccattgctttcactaccactcacctgaagtcattggtagctcaggatcatgtaacccctaagcttgcggaacagataaatcatgctttataccgtcctcttcgtaaaaccctaccaagattagaggcgaggtattttatgtccatgatcaattcaacaagtgatcatttatacaataaaactctgctgaattttgcaaagttagattttaacatattgctagatctgcacaaggaggaactcaatgaattaacaaagtggtggaaagatttagacttcactacaaaactaccttatgcaagagacagattagtggagttatatttttgggatttagggacatacttcgagcctcaatatgcatttgggagaaagataatgacccaattaaattacatattatccatcatagatgatacttatgatgcgtatggtacacttgaagaactcagcctctttactgaagcagtacaaagatggaatattgaggccgtagatatgcttccagaatacatgaaattgatttacaggacactcttagatgcttttaatgaaattgaggaagatatggccaagcaaggaagatcacactgcgtacgttatgcaaaagaggagaatcaaaaagtaattggagcatactctgttcaagccaaatggttcagtgaaggttacgttccaacaattgaggagtatatgcctattgcactaacaagttgtgcttacacattcgtcataacaaattccttccttggcatgggtgattttgcaactaaagaggtttttgaatggatctccaataaccctaaggttgtaaaagcagcatcagttatctgcagactcatggatgacatgcaaggtcatgagtttgagcagaagagaggacatgttgcgtcagctattgaatgttacacgaagcagcatggtgtctctaaggaagaggcaattaaaatgtttgaagaagaagttgcaaatgcatggaaagatattaacgaggagttgatgatgaagccaaccgtcgttgcccgaccactgctcgggacgattcttaatcttgctcgtgcaattgattttatttacaaagaggacgacggctatacgcattcttacctaattaaagatcaaattgcttctgtgctaggagaccacgttccattttga

SEQ ID NO: 136 - DNA, 1647 bp, Artificial Sequence
  CVS mutant V6
atgtcgtctggagaaacatttcgtcctactgcagatttccatcctagtttatggagaaaccatttcctcaaaggtgcttctgatttcaagacagttgatcatactgcaactcaagaacgacacgaggcactgaaagaagaggtaaggagaatgataacagatgctgaagataagcccgttcagaagttacgcttgattgatgaagtacaacgcctgggggtggcttatcactttgagaaagaaatagaagatgcaatacaaaaattatgtccaatctatattgacagtaatagagctgatctccacaccgtttcccttcattttcgattgcttaggcagcaaggaatcaagatttcatgtgatgtgtttgagaagttcaaagatgatgagggtagattcaagtcatcgttgataaacgatgttcaagggatgttaagtttgtacgaggcagcatacatggcagttcgcggagaacatatattagatgaagccattgctttcactaccactcacctgaagtcattggttgctcaggatcatgtaacccctaagcttgcggaacagataaatcatgctttataccgtcctcttcgtaaaaccctaccaagattagaggcgaggtatattatgtccatgatcaattcaacaagtgatcatttatacaataaaactctgctgaattttgcaaagttagattttaacatattgctagagctgcacaaggaggaactcaatgaattaacaaagtggtggaaagatttagacttcactacaaaactaccttatgcaagagacagattagtggagttatatttttgggatttagggacatacttcgagcctcaatatgcatttgggagaaagataatgacccaattaaattacatattatccatcatagatgatacttatgatgcgtatggtacacttgaagaactcagcctctttactgaagcagttcaaagatggaatattgaggccgtagatatgcttccagaatacatgaaattgatttacaggacacttttagatgcttttaatgaaattgaggaagatatggccaagcaaggaagatcacactgcgtacgttatgcaaaagaggagaatcaaaaagtaattggagcatactctgttcaagccaaatggttcagtgaaggttacgttccaacaattgaggagtatatgcctattgcactaacaagttgtgcttacacattcgtcataacaaattccttccttggcatgggtgattttgcaactaaagaggtttttgaatggatctccaataaccctaaggttgtaaaagcagcatcagttatctgcagactcatggatgacatgcaaggtcatgagtttgagcagaagagaggacatgttgcgtcagctattgaatgttacacgaagcagcatggtgtctctaaggaagaggcaattaaaatgtttgaagaagaagttgcaaatgcatggaaagatattaacgaggagttgatgatgaagccaaccgtcgttgcccgaccactgctcgggacgattcttaatcttgctcgtgcaattgattttatttacaaagaggacgacggctatacgcattcttacctaattaaagatcaaattgcttctgtgctaggagaccacgttccattttga

SEQ ID NO: 137 - DNA, 1647 bp, Artificial Sequence
  CVS mutant V7
atgtcgtctggagaaacatttcgtcctactgcagatttccatcctagtttatggagaaaccatttcctcaaaggtgcttctgatttcaagacagttgatcatactgcaactcaagaacgacacgaggcactgaaagaagaggtaaggagaatgataacagatgctgaagataagcctgttcagaagttacgcttgattgatgaagtacaacgcctgggggtggcttatcactttgagaaagaaatagaagatgcaatacaaaaattatgtccaatctatattgacagtgatagagctgatctccacaccgtttcccttcattttcgattgcttaggcagcaaggaatcaagatttcatgtgatgtgtttgagaagttcaaagatgatgagggtagattcaagtcatcgttgataaacgatgttcaagggatgttaagtttgtacgaggcagcatacatggcagttcgcggagaacatatattagatgaagccattgctttcactaccactcacctgaagtcattggtagctcaggatcatgtaacccctaagcttgcggaacagataaatcatgctttataccgtcctcttcgtaaaaccctaccaagattagaggcgaggtattttatgtccatgatcaattcaacaagtgatcatttatacaataaaactctgctgaattttgcaaagttagattttaacatattgctagagctgcacaaggaggaactcaatgaattaacaaagtggtggaaagatttagacttcactacaaaactaccttatgcaagagacagattagtggagttatatttttgggatttagggacatacttcgagcctcaatatgcatttgggagaaagataatgacccaattaaattacatattatccatcatagatgatacttatgatgcgtatggtacacttgaagaactcagcctctttactgaagcagttcaaagatggaatattgaggccgtagatatgcttccagaatacatgaaattgatttacaggacactcttagatgcttttaatgaaattgaggaagatatggccaagcaaggaagatcacactgcgtacgttatgcaaaagaggagaatcaaaaagtaattggagcatactctgttcaagccaaatggttcagtgaaggttacgttccaacaattgaggagtatatgcctattgcactaacaagttgtgcttacacattcgtcataacaaattccttccttggcatgggtgattttgcaactaaagaggtttttgaatggatctccaataaccctaaggttgtaaaagcagcatcagttatctgcagactcatggatgacatgcaaggtcatgagtttgagcagaagagaggacatgttgcgtcagctattgaatgttacacgaagcagcatggtgtctctaaggaagaggcaattaaaatgtttgaagaagaagttgcaaatgcatggaaagatattaacgaggagttgatgatgaagccaaccgtcgttgcccgaccactgctcgggacgattcttaatcttgctcgtgcaattgattttatttacaaagaggacgacggctatacgcattcttacctaattaaagatcaaattgcttctgtgctaggagaccacgttccattttga

SEQ ID NO: 138 - DNA, 1647 bp, Artificial Sequence
  CVS mutant V8
atgtcgtctggagaaacatttcgtcctactgcagatttccatcctagtttatggagaaaccatttcctcaaaggtgcttctgatttcaagacagttgatcatactgcaactcaagaacgacacgaggcactgaaagaagaggtaaggagaatgataacagatgctgaagataagcctgttcagaagttacgcttgattgatgaagtacaacgcctgggggtggcttatcactttgagaaagaaatagaagatgcaatacaaaaattatgtccaatctatattgacagtaatagagctgatctccacaccgtttcccttcattttcgattgcttaggcagcaaggaatcaagatttcatgtgatgtgtttgagaagttcaaagatgatgagggtagattcaagtcatcgttgataaacgatgttcaagggatgttaagtttgtacgaggcagcatacatggcagttcgcggagaacatatattagatgaagccattgctttcactaccactcacctgaagtcattggtagctcaggatcatgtaacccctaagcttgcggaacagataaatcatgctttataccgtcctcttcgtaaaaccctaccaagattagaggcgaggtattttatgtccatgatcaattcaacaagtgatcatttatacaataaaactctgctgaattttgcaaagttagattttaacatattgctagagctgcacaaggaggaactcaatgaattaacaaagtggtggaaagatttagacttcactacaaaactaccttatgcaagagacagattagtggagttatatttttgggatttagggacatacttcgagcctcaatatgcatttgggagaaagataatgacccaattaaattacatattatccatcatagatgatacttatgatgcgtatggtacacttgaagaactcagcctctttactgaagcagttcaaagatggaatattgaggccgtagatatgcttccagattacatgaaattgatttacaggacactcttagatgcttttaatgaaattgaggaagatatggccaagcaaggaagatcacactgcgtacgttatgcaaaagaggagattcaaaaagtaattggagcatactctgttcaagccaaatggttcagtgaaggttacgttccaacaattgaggagtatatgcctattgcactaacaagttgtgcttacacattcgtcataacaaattccttccttggcatgggtgattttgcaactaaagaggtttttgaatggatctccaataaccctaaggttgtaaaagcagcatcagttatctgcagactcatggatgacatgcaaggtcatgagtttgagcagaagagaggacatgttgcgtcagctattgaatgttacacgaagcagcatggtgtctctaaggaagaggcaattaaaatgtttgaagaagaagttgcaaatgcatggaaagatattaacgaggagttgatgatgaagccaaccgtcgttgcccgaccactgctcgggacgattcttaatcttgctcgtgcaattgattttatttacaaagaggacgacggctatacgcattcttacctaattaaagatcaaattgcttctgtgctaggagaccacgttccattttga

SEQ ID NO: 139 - DNA, 1647 bp, Artificial Sequence
  CVS mutant V9
atgtcgtctggagaaacatttcgtcctactgcagatttccatcctagtttatggagaaaccatttcctcaaaggtgcttctgatttcaagacagttgatcatactgcaactcaagaacgacacgaggcactgaaagaagaggtaagaagaatgataacagatgctgaagataagcctgttcagaagttacgcttgattgatgaagtacaacgcctgggggtggcttatcactttgagaaagaaatagaagatgcaatacaaaaattatgtccaatctatattgacagtaatagagctgatctccacaccgtttcccttcattttcgattgcttaggcagcaaggaatcaagatttcatgtgatgtgtttgagaagttcaaagatgatgagggtagattcaagtcatcgttgataaacgatgttcaagggatgttaagtttgtacgaggcagcatacatggcagttcgcggagaacatatattagatgaagccattgctttcactaccactcacctgaagtcattggtagctcaggatcatgtaacccctaagcttgctgaacagataaatcatgctttataccgtcctcttcgtaaaaccctaccaagattagaggcgaggtattttatgtccatgatcgattcaacaagtgatcatttatacaataaaactctgctgaattttgcaaagttagattttaacatattgctagagctgcacaaggaggaactcaatgaattaacaaagtggtggaaagatttagacttcactacaaaactaccttatgcaagagacagattagtggagttatatttttgggatttagggacatacttcgagcctcaatatgcatttgggagaaagataatgacccaattaaattacatattatccatcatagatgatacttatgatgcgtatggtacacttgaagaactcagcctctttactgaagcagttcaaagatggaatattgaggccgtagatatgcttccagaatacatgaaattgatttacaggacactcttagatgcttttaatgaaattgaggaagatatggccaagcaaggaagatcacactgcgtacgttatgcaaaagaggagaatcaaaaagtaattggagcatactctgttcaagccaaatggttcagtgaaggttacgttccaacaattgaggagtatatgcctattgcactaacaagttgtgcttacagattcgtcataacaaattccttccttggcatgggtgattttgcaactaaagaggtttttgaatggatctccaataaccctaaggttgtaaaagcagcatcagttatctgcagactcatggatgacatgcaaggtcatgagtttgagcagaagagaggacatgttgcgtcagctattgaatgttacacgaagcagcatggtgtctctaaggaagaggcaattaaaatgtttgaagaagaagttgcaaatgcatggaaagatattaacgaggagttgatgatgaagccaaccgtcgttgcccgaccactgctcgggacgattcttaatcttgctcgtgcaattgattttatttacaaagaggacgacggctatacgcattcttacctaattaaagatcaaattgcttctgtgctaggagaccacgttccattttga

SEQ ID NO: 140 - DNA, 1647 bp, Artificial Sequence
  CVS mutant V10
atgtcgtctggagaaacatttcgtcctactgcagatttccatcctagtttatggagaaaccatttcctcaaaggtgcttctgatttcaagacagttgatcatactgcaactcaagaacgacacgaggcactgaaagaagaggtaagaagaatgataacagatgctgaagataagcctgttcagaagttacgcttgattgatgaagtacaacgcctgggggtggcttatcactttgagaaagaaatagaagatgcaatacaaaaattatgtccaatctatattgacagtaatagagctgatctccacaccgtttcccttcattttcgattgcttaggcagcaaggaatcaagatttcatgtgatgtgtttgagaagttcaaagatgatgagggtagattcaagtcatcgttgataaacgatgttcaagggatgttaagtttgtacgaggcagcatacatggcagttcgcggagaacatatattagatgaagccattgctttcactaccactcacctgaagtcattggtagctcaggatcatgtaacccctaagcttgctgaacagataaatcatgctttataccgtcctcttcgtaaaaccctaccaagattagaggcgaggtattttatgtccatgatcgattcaacaagtgatcatttatacaataaaactctgctgaattttgcaaagttagattttaacatattgctagagctgcacaaggaggaactcaatgaattaacaaagtggtggaaagatttagacttcactacaaaactaccttatgcaagagacagattagtggagttatatttttgggatttagggacatacttcgagcctcaatatgcatttgggagaaagataatgacccaattaaattacatattatccatcatagatgatacttatgatgcgtatggtacacttgaagaactcagcctctttactgaagcagttcaaaggtggaatattgaggccgtagatatgcttccagaatacatgaaattgatttacaggacactcttagatgtttttaatgaaattgaggaagatatggccaagcaaggaagatcacactgcgtacgttatgcaaaagaggagaatcaaaaagtaattggagcatactctgttcaagccaaatggttcagtgaaggttacgttccaacaattgaggagtatatgcctattgcactaacaagttgtgcttacagatttgtcataacaaattccttccttggcatgggtgattttgcaactaaagaggtttttgaatggatctccaataaccctaaggttgtaaaagcagcatcagttatctgcagactcatggatgacatgcaaggtcatgagtttgagcagaagagaggacatgttgcgtcagctattgaatgttacacgaagcagcatggtgtctctaaggaagaggcaattaaaatgtttgaagaagaagttgcaaatgcatggaaagatattaacgaggagttgatgatgaagccaaccgtcgttgcccgaccactgctcgggacgattcttaatcttgctcgtgcaattgattttatttacaaagaggacgacggctatacccattcttacctaattaaagagcaaattgcatctgtgctaggagaccacgttccattttga

SEQ ID NO: 141 - DNA, 1647 bp, Artificial Sequence
  CVS mutant V12
atgtcgtctggagaaacatttcgtcctactgcagatttccatcctagtttatggagaaaccatttcctcaaaggtgcttctgatttcaagacagttgatcatactgcaactcaagaacgacacgaggcactgaaagaagaggtaagaagaatgataacagatgctgaagataagcctattcagaagttacgcttgattgatgaagtacaacgcctgggggtggcttatcactttgagaaagaaatagaagatgcaatacaaaaattatgtccaatctatattgacagtaatagagctgatctccacaccgtttcccttcattttcgattgcttaggcagcaaggaatcaagatttcatgtgatgtgtttgagaagttcaaagatgatgagggtagattcaagtcatcgttgataaacgatgttcaagggatgttaagtttgtacgaggcagcatacatggcagttcgcggagaacatatattagatgaagccattgctttcactaccactcacctgaagtcattggtagctcaggatcatgtaacccctaagcttgctgaacagataaatcatgctttataccgtccccttcgtaaaaccctaccaagattagaggcgaggtattttatgtccatgatcgattcaacaagtgatcatttatacaataaaactctgctgaattttgcaaagttagattttaacatattgctagagctgcacaaggaggaactcaatgaattaacaaagtggtggaaagatttagacttcactacaaaactaccttatgcaagagacagattagtggagttatatttttgggatttagggacatacttcgagcctcaatatgcatttgggagaaagataatgacccaattaaattacatattatccatcatagatgatacttatgatgcgtatggtacacttgaagaactcagcctctttactgaagcagttcaaagatggaatattgaggccgtagatatgcttccagaatacatgaaattgatttacaggacactcttagatacttttaatgaaattgaggaagatatggccaagcaaggaagatcacactgcgtacgttatgcaaaagaggagaatcaaaaagtaattggagcatactctgttcaagccaaatggttcagtgaaggttacgttccaacaattgaggagtatatgcctattgcactaacaagttgtgcttacagattcgtcataacaaattccttccttggcatgggtgattttgcaactaaagaggtttttgaatggatctccaataaccctaaggttgtaaaagcagcatcagttatctgcagactcatggatgacatgcaaggtcatgagtttgagcagaagagaggacatgttgcgtcagctattgaatgttacacgaagcagcatggtgtctctaaggaagaggcaattaaaatgtttgaagaagaagttgcaaatgcatggaaagatattaacgaggagttgatgatgaagccaaccgtcgttgcccgaccactgctcgggacgattcttaatcttgctcgtgcaattgattttatttacaaagaggacgacggctatacgcattcttacctaattaaagatcaaattgcttctgtgctaggagaccacgttccattttga

SEQ ID NO: 142 - DNA, 1647 bp, Artificial Sequence
  CVS mutant V13
atgtcgtctggagaaacatttcgtcctactgcagatttccatcctagtttatggagaaaccatttcctcaaaggtgcttctgatttcaagacagttgatcatactgcaactcaagaacgacacgaggcactgaaagaagaggtaagaagaatgataacagatgctgaagataagcctgttcagaagttacgcttgattgatgaagtacaacgcctgggggtggcttatcactttgagaaagaaatagaagatgcaatacaaaaattatgtccaatctatattgacagtaatagagctgatctccacaccgtttcccttcattttcgattgcttaggcagcaaggaatcaagatttcatgtgatgtgtttgagaagttcaaagatgatgagggtagattcaagtcatcgttgataaacgatgttcaagggatgttaagtttgtacgaggcagcatacatggcagttcgcggagaacatatattagatgaagccattgctttcactaccactcacctgaagtcattggtagctcaggatcatgtaacccctaagcttgctgaacagataaatcatgctttataccgtcctcttcgtaaaaccctaccaagattagaggcgaggtattttatgtccatgatcgattcaacaagtgatcatttatacaataaaactctgctgaattttgcaaagttagattttaacatattgctagagctgcacaaggaggaactcaatgaattaacaaagtggtggaaagatttagacttcactacaaaactaccttatgcaagagacagattagtggagttatatttttgggatttagggacatacttcgagcctcaatatgcatttgggagaaagataatgacccaattaaattacatattatccatcatagatgatacttatgatgcgtatggtacacttgaagaactcagcctctttactgaagcagttcaaagatggaatattgaggccgtagatatgcttccagaatacatgaaattgatttacaggacactcttagatgcttttaatgaaattgaggaagatatggccaagcaaggaagatcacactgcgtacgttatgcaaaagaggagaatcaaaaagtaattggagcatactctgttcaagccaaatggttcagtgaaggttacgttccaacaattgaggagtatatgcctattgcactaacaagttgtgcttacagattcgtcataacaaattccttccttggcatgggtgattttgcaactaaagaggtttttgaatggatctccagtaaccctaaggttgtaaaagcagcatcagttatctgcagactcatggatgacatgcaaggtcatgagtttgagcagaagagaggacatgttgcgtcagctattgaatgttacacgaagcagcatggtgtctctaaggaagaggcaattaaaatgtttgaagaagaagttgcaaatgcatggaaagatattaacgaggagttgatgatgaagccaaccgtcgttgcccgaccactgctcgggacgattcttaatcttgctcgtgcaattgattttatttacaaagaggacgacggctatacgcattcttacctaattaaagatcaaattgcttctgtgctaggagaccacgttccattttga

SEQ ID NO: 143 - DNA, 1648 bp, Artificial Sequence
  CVS mutant V14
atgtcgtctggagaaacatttcgtcctactgcagatttccatcctagtttatggagaaaccatttcctcaaaggtgcttctgatttcaagacagttgatcatactgcaactcaagaacgacacgaggcactgaaagaagaggtaagaagaatgataacagatgctgaagataagcctgttcagaagttacgcttgattgatgaagtacaacgcctgggggtggcttatcactttgagaaagaaatagaagatgcaatacaaaaattatgtccaatctatattgacagtaatagagctgatctccacaccgtttcccttcattttcgattgcttaggcagcaaggaatcaagatttcatgtgatgtgtttgagaagttcaaagatgatgagggtagattcaagtcatcgttgataaacgatgttcaagggatgttaagtttgtacgaggcagcatacatggcagttcgcggagaacatatattagatgaagccattgctttcactaccactcacctgaagtcattggtagctcaggatcatgtaacccctaagcttgctgaacagataaatcatgctttataccgtcctcttcgtaaaaccctaccaagattagaggcgaggtattttatgtccatgatcgattcaacaagtgatcatttatacaataaaactctgctgaattttgcaaagttagattttaacatattgctagagctgcacaaggaagaactcaatgaattaacaaagtggtggaaagatttagacttcactacaaaactaccttatgcaagagacagattagtggagttatatttttgggatttagggacatacttcgagcctcaatatgcatttgggagaaagataatgaccaaattaaattacatattatccatcatagatgatacttatgatgcgtatggtacacttgaagaactcagcctctttactgaagcagttcaaagatggaatattgaggccgtagatatgcttccagaatacatgaaattgatttacaggacactcttagatgcttttaatgaaattgaggaagatatggccaagcaaggaagatcacactgcgtacgttatgcaaaagaggagaatcaaaaagtaattggagcatactctgttcaagccaaatggttcagtgaaggttacgttccaacaattgaggagtatatgcctattgcactaacaagttgtgcttacagattcgtcataacaaattccttccttggcatgggtgattttgcaactaaagaggtttttgaatggatctccaataaccctaaggttgtaaaagcagcatcagttatctgcagactcatggatgacatgcaaggtcatgagtttgagcagaagagaggacatgttgcgtcagctattgaatgttacacgaagcagcatggtgtctctaaggaagaggcaattaaaatgtttgaagaagaagttgcaaatgcatggaaagatattaacgaggagttgatgatgaagccaaccgtcgttgcccgaccactgctcgggacgattcttaatcttgctcgtgcaattgattttatttacaaagaggacgacggctatacgcattcttacctaattaaagatcaaattgcttctgtgctaggagaccacgttccattttgaa

SEQ ID NO: 144 - DNA, 1647 bp, Artificial Sequence
  CVS mutant V15
atgtcgtctggagaaacatttcgtcctactgcagatttccatcctagtttatggagaaaccatttcctcaaaggtgcttctgatttcaagacagttgatcatactgcaactcaagaacgacacgaagcactgaaagaagaggtaagaagaatgataacagatgctgaagataagcctggtcagaagttacgcttgattgatgaagtacaacgcctgggggtggcttatcactttgagaaagaaatagaagatgcaatacaaaaattatgtccaatctatattgacagtaatagagctgatctccacaccgtttcccttcattttcgattgcttaggcagcaaggaatcaagatttcatgtgatgtgtttgagaagttcaaagatgatgagggtagattcaagtcatcgttgataaacgatgttcaagggatgttaagtttgtacgaggcagcatacatggcagttcgcggagaacatatattagatgaagccattgctttcactactactcacctgaagtcattggtagctcaggatcatgtaacccctaagcttgctgaacagataaatcatgctttataccgtcctcttcgtaaaaccctaccaagattagaggcgaggtattttatgtccatgatcgattcaacaagtgatcatttatacaataaaactctgctgaattttgcaaagttagattttaacatattgctagagctgcacaaggaggaactcaatgaattaacaaagtggtggaaagatttagacttcactacaaaactaccttatgcaagagacagattagtggagttatatttttgggatttagggacatacttcgagcctcaatatgcatttgggagaaagataatgacccaattaaattacatattatccatcatagatgatacttatgatgcgtatggtacacttgaagaactcagcctctttactgaagcagttcaaagatggaatattgaggccgtagatatgcttccagaatacatgaaattgatttacaggacactcttagatgcttttaatgaaattgaggaagatatggccaagcaaggaagatcacactgcgtacgttatgcaaaagaggagaatcaaaaagtaattggagcatactctgttcaagccaaatggttcagtgaaggttacgttccaacaattgaggagtatatgcctattgcactaacaagttgtgcttacagattcgtcataacaaattccttccttggcatgggtgattttgcaactaaagaggtttttgaatggatctccaataaccctaaggttgtaaaagcagcatcagttatctgcagactcatggatgacatgcaaggtcatgagtttgagcagaagagaggacatgttgcgtcagctattgaatgttacacgaagcagcatggtgtctctaaggaagaggcaattaaaatgtttgaagaagaagttgcaaatgcatggaaagatattaacgaggagttgatgatgaagccaaccgtcgttgcccgaccactgctcgggacgattcttaatcttgctcgtgcaattgattttatttacaaagaggacgacggctatacgcattcttacctaattaaagatcaaattgcttctgtgctaggagaccacgttccattttga

SEQ ID NO: 145 - DNA, 1647 bp, Artificial Sequence
  CVS mutant V16
atgtcgtctggagaaacatttcgtcctactgcagatttccatcctagtttatggagaaaccatttcctcaaaggtgcttctgatttcaagacagttgatcatactgcaactcaagaacgacacgaggcactgaaagaagaggtaagaagaatgataacagatgctgaagataagcctattcagaagttacgcttgattgatgaagtacaacgcctgggggtggcttatcactttgagaaagaaatagaagatgcaatacaaaaattatgtccaatctatattgacagtaatagagctgatctccacaccgtttcccttcattttcgattgcttaggcagcaaggaatcaagatttcatgtgatgtgtttgagaagttcaaagatgatgagggtagattcaagtcatcgttgataaacgatgttcaagggatgttaagtttgtacgaggcagcatacatggcagttcgcggagaacatatattagatgaagccattgctttcactaccactcacctgaagtcattggtagctcaggatcatgtaacccctaagcttgctgaacagataaatcatgctttataccgtccccttcgtaaaaccctaccaagattagaggcgaggtattttatgtccatgatcgattcaacaagtgatcatttatacaataaaactctgctgaattttgcaaagttagattttaacatattgctagagctgcacaaggaggaactcaatgaattaacaaagtggtggaaagatttagacttcactacaaaactaccttatgcaagagacagattagtggagctatatttttgggatttagggacatacttcgagcctcaatatgcatttgggagaaagataatgacccaattaaattacatattatccatcatagatgatacttatgatgcgtatggtacacttgaagaactcagcctctttactgaagcagttcaaagatggaatattgaggccgtagatatgcttccagaatacatgaaattgatttacaggacactcttagatacttttaatgaaattgaggaagatatggccaagcaaggaagatcacactgcgtacgttatgcaaaagaggagaatcaaaaagtaattggagcatactctgttcaagccaaatggttcagtgaaggttacgttccaacaattgaggagtatatgcctattgcactaacaagttgtgcttacagattcgtcataacaaattccttccttggcatgggtgattttgcaactaaagaggtttttgaatggatctccggtaaccctaaggttgtaaaagcagcatcagttatctgcagactcatggatgacatgcaaggtcatgagtttgagcagaagagaggacatgttgcgtcagctattgaatgttacacgaagcagcatggtgtctctaaggaagaggcaattaaaatgtttgaagaagaagttgcaaatgcatggaaagatattaacgaggagttgatgatgaagccaaccgtcgttgcccgaccactgctcgggacgattcttaatcttgctcgtgcaattgattttatttacaaagaggacgacggctatacgcattcttacctaattaaagatcaaattgcttctgtgctaggagaccacgttccattttga

SEQ ID NO: 146 - DNA, 1647 bp, Artificial Sequence
  CVS mutant V17
atgtcgtctggagaaacatttcgtcctactgcagatttccatcctagtttatggagaaaccatttcctcaaaggtgcttctgatttcaagacagttgatcatactgcaactcaagaacgacacgaggcactgaaagaagaggtaagaagaatgataacagatgctgaagataagcctattcagaagttacgcttgattgatgaagtacaacgcctgggggtggcttatcactttgagaaagaaatagaagatgcaatacaaaaattatgtccaatctatattgacagtaatagagctgatctccacaccgtttcccttcattttcgattgcttaggcagcaaggaatcaagatttcatgtgatgtgtttgagaagttcaaagatgatgagggtagattcaagtcatcgttgataaacgatgttcaagggatgttaagtttgtacgaggcagcatacatggcagttcgcggagaacatatattagatgaagccattgctttcactaccactcacctgaagtcattggtagctcaggatcatgtaacccctaagcttgctgaacagataaatcatgctttataccgtccccttcgtaaaaccctaccaagattagaggcgaggtattttatgtccaggatcgattcaacaagtgatcatttagtcaataaaactctgctgaattttgcaaagttagattttaacatattgctagagctgcacaaggaggaactcaatgaattaacaaagtggtggaaagatttagacttcactacaaaactaccttatgcaagagacagattagtggagctatatttttgggatttagggacatacttcgagcctcaatatgcatttgggagaaagataatgacccaattaaattacatattatccatcatagatgatacttatgatgcgtatggtacacttgaagaactcagcctctttactgaagcagttcaaagatggaatattgaggccgtagatatgcttccagaatacatgaaattgatttacaggacactcttagatacttttaatgaaattgaggaagatatggccaagcaaggaagatcacactgcgtacgttatgcaaaagaggagaatcaaaaagtaattggagcatactctgttcaagccaaatggttcagtgaaggttacgttccaacaattgaggagtatatgcctattgcactaacaagttgtgcttacagattcgtcataacaaattccttccttggcatgggtgattttgcaactaaagaggtttttgaatggatctccggtaaccctaaggttgtaaaagcagcatcagttatctgcagactcatggatgacatgcaaggtcatgagtttgagcagaagagaggacatgttgcgtcagctattgaatgttacacgaagcagcatggtgtctctaaggaagaggcaattaaaatgtttgaagaagaagttgcaaatgcatggaaagatattaacgaggagttgatgatgaagccaaccgtcgttgcccgaccactgctcgggacgattcttaatcttgctcgtgcaattgattttatttacaaagaggacgacggctatacgcattcttacctaattaaagatcaaattgcttctgtgctaggagaccacgttccattttga

SEQ ID NO: 147 - DNA, 1647 bp, Artificial Sequence
  CVS mutant V20
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttattttgaaccacaatacgcttttggtagaaaaatcatgactaaattgaactacattttgtccattattgatgatacctacgatgcttacggtactttggaagaattgtctttgttcaccgaagcttcggctcgttggaacattaaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 148 - DNA, 1647 bp, Artificial Sequence
  CVS mutant V21
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaggaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttattttgaaccacaatacgcttttggtagaaaaatcatgactaaattgaactacattttgtccattattgatgatacctacgatgcttacggtactttggaagaattgtctttgttcaccgaagctggtgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 149 - DNA, 1647 bp, Artificial Sequence
  CVS mutant V22
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttattttgaaccacaatacgcttttggtagaaaaatcatgactaaattgaactacattttgtccattattgatgatacctacgatgcttacggtactttggaagaattgtctatgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 150 - DNA, 1647 bp, Artificial Sequence
  CVS mutant V24
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttattttgaaccacaatacgcttttggtagaaaaatcatgactaaattgaactacattttgtccattattgatgatacctacgatgcttacggtactttggaagaattgtctttgttcaccgaagctggcgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 151 - DNA, 1647 bp, Artificial Sequence
  CVS mutant V25
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttattttgaaccacaatacgcttttgggagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 152 - DNA, 1647 bp, Artificial Sequence
  CVS mutant V26
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagacttgttgaattgtacttttgggatttgggtacttattttgaaccacaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 153 - DNA, 1647 bp, Artificial Sequence
  CVS mutant V27
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttattttgaaccacaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaacggagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 154 - DNA, 1647 bp, Artificial Sequence
  CVS mutant V28
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttattttgaaccacaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaaggagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 155 - DNA, 1647 bp, Artificial Sequence
  CVS mutant V29
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttattttgaaccacaatacgcttttggtagaaaaatcatgactaaattgaactacattttgtccattattgatgatacctacgatgcttacggtactttggaagaattgtctctgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 156 - DNA, 1647 bp, Artificial Sequence
  CVS mutant V30
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttattttgaaccacaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaacgtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 157 - DNA, 1647 bp, Artificial Sequence
  CVS mutant V31
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttattttgaaccacaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattgacaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 158 - DNA, 1647 bp, Artificial Sequence
  CVS mutant V32
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttattttgaaccacaatacgcttttggtagaaaaatcatgactaaattgaactacattttgtcctacattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 159 - DNA, 1647 bp, Artificial Sequence
  CVS mutant V33
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttattttgaaccacaatacgcttttggtagaaaaatcatgactaaattgaactacattttgtccattattgatgatacctacgatgcttacggtactttggaagaattgtctttgttcaccgaagctggggctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 160 - DNA, 1647 bp, Artificial Sequence
  CVS mutant V34
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttattttgaaccacaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctctttgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 161 - DNA, 1647 bp, Artificial Sequence
  CVS mutant V35
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttattttgaaccacaatacgcttttggtagaaaaatcatgactaaattgaactacattttgtccattattgatgatacctacgatgcttacggtactttggaagaattgtctttgttcagtgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 162 - DNA, 1647 bp, Artificial Sequence
  CVS mutant V36
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttattttgaaccacaatacgcttttggtagaaaaatcatgactaaattgaactacattttgtccattattgatgatacctacgatgcttacggtactttggaagaattgtctttgttcaccgaagctgatgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 163 - DNA, 1647 bp, Artificial Sequence
  CVS mutant V37
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttggggacttattttgaaccacaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 164 - DNA, 1647 bp, Artificial Sequence
  CVS mutant V38
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttattttgaaccacaatacgcttttggtagaaaaatcatgactaaattgaactacattttgtccattattgatgatacctacgatgcttacggtactttggaagaattgtcgttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 165 - DNA, 1647 bp, Artificial Sequence
  CVS mutant V40
atgtcatctggtgaaacttttagaccaactgctgattttcatccatctttgtggagaaatcattttttggctggtgcatcagattttaagactgttgatcatacagctacagttgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttattttgaaccacaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 166 - DNA, 1647 bp, Artificial Sequence
  CVS mutant V41
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttattttgaaccacaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattggcaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaaggattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 167 - DNA, 1647 bp, Artificial Sequence
  CVS mutant V39
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttattttgaaccacaatacgcttttggtagaaaaatcatgactaaattgaactacattttgtccattattgatgatacctacgatgcttacggtactttggaagaattgtctttgttcaccgaagctgacgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 168 - DNA, 1647 bp, Artificial Sequence; identical to SEQ ID NO: 149
  CVS mutant V23

SEQ ID NO: 169 - DNA, 1647 bp, Artificial Sequence
  CVS mutant V42
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttattttgaatcacaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagattatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 170 - DNA, 1647 bp, Artificial Sequence
  CVS mutant V43
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttattttgaaccacaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgactattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 171 - DNA, 1647 bp, Artificial Sequence
  CVS mutant V44
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttattttgaaccacaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgcgattaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 172 - DNA, 1647 bp, Artificial Sequence
  CVS mutant V45
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttattttgaaccacaatacgcttttggtagaaaaatcatgactaaattgaactacattttgtccattattgatgatacctacgatgcttacggtactttgcccgaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 173 - DNA, 1647 bp, Artificial Sequence
  CVS mutant V46
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttattttgaaccacaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcacaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 174 - DNA, 1647 bp, Artificial Sequence
  CVS mutant V47
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttattttgaaccacaatacgcttttggtagaaaaatcatgactaaattgaactacattttgtccattattgatgatacctacgatgcttacggtactttggaagaattgtctttgttctcagaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 175 - DNA, 1647 bp, Artificial Sequence
  CVS mutant V48
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttattttgaaccacaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttggtggatacattcaacgaaatagaagaggatatggctaaacaaggtagatctgcctgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 176 - DNA, 1647 bp, Artificial Sequence
  CVS mutant V49
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttattttgaaccatcttacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 177 - DNA, 1647 bp, Artificial Sequence
  CVS mutant V50
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttattttgaaccacaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaggggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 178 - DNA, 1647 bp, Artificial Sequence
  CVS mutant V51
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttattttgaaccacaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcttggaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 179 - DNA, 1647 bp, Artificial Sequence
  CVS mutant V52
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttattttgaaccacaatacgcttttggtagaaaaatcatgactaaattgaactacattttgtccattattgatgatacctacgatgcttacggtactttgaccgaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 180 - DNA, 1647 bp, Artificial Sequence
  CVS mutant V53
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttattttgaaccactgtacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 181 - DNA, 1647 bp, Artificial Sequence
  CVS mutant V54
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttattttgaaccacaatacgcttttggtagaaaaatcatgactaaattgaactacattttgtccattattgatgatacctacgatgcttacggtactttggaagaattgacgttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 182 - DNA, 1647 bp, Artificial Sequence
  CVS mutant V55
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttattttgaaccacaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattggtaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 183 - DNA, 1647 bp, Artificial Sequence
  CVS mutant V56
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttattttgaaccacaatacgcttttggtagaaaaatcatgactaaattgaactacattttgtccattattgatgatacctacgatgcttacggtactcacgaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgcaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 184 - DNA, 1647 bp, Artificial Sequence
  CVS mutant V57
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccatcttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttattttgaaccacaatacgcttttggtagaaaaatcatgactaaattgaactacattttgtccattattgatgatacctacgatgcttacggtactttggaagaatgctctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 185 - DNA, 1647 bp, Artificial Sequence
  CVS mutants V58 and V59
atgtcatctggtgaaacttttagaccaactgctgattttcatccatctttgtggagaaatcattttttgcaaggtgcatcagattttaagactgttgatcatacagctacaaatgaaagacatgaagctttgaaggaagaagttagaagaatgattactgatgcagaagatcaaccaattcaaaaattgagattgattgatgaagttcaaagattgggtgttgcttaccattttgaaaaagaaattgaagatgctattcaacaattgtgtccaattcatattgattctgataaagctgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttgggtacttattttgaatcacaatacgcttttggtagaaaaatcatgactaaattgaactacattttgtcctacattgatgatacctacgatgcttacggtactcaccccgaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 186 - DNA, 1647 bp, Artificial Sequence
  CVS mutant V60
atgtcatctggtgaaacttttagaccaactgctgattttcatccatctttgtggagaaatcattttttgcaaggtgcatcagattttaagactgttgatcatacagctacaaatgaaagacatgaagctttgaaggaagaagttagaagaatgattactgatgcagaagatcaaccaattcaaaaattgagattgattgatgaagttcaaagattgggtgttgcttaccattttgaaaaagaaattgaagatgctattcaacaattgtgtccaattcatattgattctgataaagctgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttggggacttattttgaatcactgtacgcttttggtagaaaaatcatgactaaattgaactacattttgtccattattgatgatacctacgatgcttacggtactcacgaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 187 - DNA, 1647 bp, Artificial Sequence
  CVS mutant V61
atgtcatctggtgaaacttttagaccaactgctgattttcatccatctttgtggagaaatcattttttgcaaggtgcatcagattttaagactgttgatcatacagctacaaatgaaagacatgaagctttgaaggaagaagttagaagaatgattactgatgcagaagatcaaccaattcaaaaattgagattgattgatgaagttcaaagattgggtgttgcttaccattttgaaaaagaaattgaagatgctattcaacaattgtgtccaattcatattgattctgataaagctgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttggggacttattttgaatcactgtacgcttttggtagaaaaatcatgactaaattgaactacattttgtcctacattgatgatacctacgatgcttacggtactttgcccgaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 188 - DNA, 1647 bp, Artificial Sequence
  CVS mutant V62
atgtcatctggtgaaacttttagaccaactgctgattttcatccatctttgtggagaaatcattttttgcaaggtgcatcagattttaagactgttgatcatacagctacaaatgaaagacatgaagctttgaaggaagaagttagaagaatgattactgatgcagaagatcaaccaattcaaaaattgagattgattgatgaagttcaaagattgggtgttgcttaccattttgaaaaagaaattgaagatgctattcaacaattgtgtccaattcatattgattctgataaagctgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttggggacttattttgaatcacaatacgcttttggtagaaaaatcatgactaaattgaactacattttgtccattattgatgatacctacgatgcttacggtactttggaagaatgcacgatgttcagtgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 189 - DNA, 1647 bp, Artificial Sequence
  CVS mutant V63
atgtcatctggtgaaacttttagaccaactgctgattttcatccatctttgtggagaaatcattttttgcaaggtgcatcagattttaagactgttgatcatacagctacaaatgaaagacatgaagctttgaaggaagaagttagaagaatgattactgatgcagaagatcaaccaattcaaaaattgagattgattgatgaagttcaaagattgggtgttgcttaccattttgaaaaagaaattgaagatgctattcaacaattgtgtccaattcatattgattctgataaagctgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttgggtacttattttgaatcacaatacgcttttggtagaaaaatcatgactaaattgaactacattttgtccattattgatgatacctacgatgcttacggtactttggaagaattgtcgctgttcaccgaagctgttgctcgttggaacattgaagctgttgacatgttgccagattatatgcgattaatctacagaactttgttggatacattcttggaaatagaagaggatatggctaaacaacgtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 190 - DNA, 1647 bp, Artificial Sequence
  CVS mutant V64
atgtcatctggtgaaacttttagaccaactgctgattttcatccatctttgtggagaaatcattttttgcaaggtgcatcagattttaagactgttgatcatacagctacaaatgaaagacatgaagctttgaaggaagaagttagaagaatgattactgatgcagaagatcaaccaattcaaaaattgagattgattgatgaagttcaaagattgggtgttgcttaccattttgaaaaagaaattgaagatgctattcaacaattgtgtccaattcatattgattctgataaagctgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttggggacttattttgaaccacaatacgcttttggtagaaaaatcatgactaaattgaactacattttgtccattattgatgatacctacgatgcttacggtactcacaccgaatgcacgatgttcagtgaagctggcgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 191 - DNA, 1647 bp, Artificial Sequence
  CVS mutant V65
atgtcatctggtgaaacttttagaccaactgctgattttcatccatctttgtggagaaatcattttttgcaaggtgcatcagattttaagactgttgatcatacagctacaaatgaaagacatgaagctttgaaggaagaagttagaagaatgattactgatgcagaagatcaaccaattcaaaaattgagattgattgatgaagttcaaagattgggtgttgcttaccattttgaaaaagaaattgaagatgctattcaacaattgtgtccaattcatattgattctgataaagctgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttggggacttattttgaaccacaatacgcttttggtagaaaaatcatgactaaattgaactacattttgtccattattgatgatacctacgatgcttacggtactcacaccgaatgcacgatgttcagtgaagctggggctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 192 - DNA, 1647 bp, Artificial Sequence
  CVS mutant V66
atgtcatctggtgaaacttttagaccaactgctgattttcatccatctttgtggagaaatcattttttgcaaggtgcatcagattttaagactgttgatcatacagctacaaatgaaagacatgaagctttgaaggaagaagttagaagaatgattactgatgcagaagatcaaccaattcaaaaattgagattgattgatgaagttcaaagattgggtgttgcttaccattttgaaaaagaaattgaagatgctattcaacaattgtgtccaattcatattgattctgataaagctgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttggggacttattttgaatcacaatacgcttttggtagaaaaatcatgactaaattgaactacattttgtccattattgatgatacctacgatgcttacggtactttggaagaattgtctttgttcagtgaagctgttgctcgttggaacattgaagctgttgacatgttgccagattatatgcgaattatctacagaactttgttggatacattcttggaaatagaagaggatatggctaaacaacggagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 193 - DNA, 1647 bp, Artificial Sequence
  CVS mutant V67
atgtcatctggtgaaacttttagaccaactgctgattttcatccatctttgtggagaaatcattttttgcaaggtgcatcagattttaagactgttgatcatacagctacaaatgaaagacatgaagctttgaaggaagaagttagaagaatgattactgatgcagaagatcaaccaattcaaaaattgagattgattgatgaagttcaaagattgggtgttgcttaccattttgaaaaagaaattgaagatgctattcaacaattgtgtccaattcatattgattctgataaagctgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttgggtacttattttgaaccacaatacgcttttggtagaaaaatcatgactaaattgaactacattttgtccattattgatgatacctacgatgcttacggtactttggaagaattgtctttgttcagtgaagctgttgctcgttggaacattgaagctgttgacatgttgccagattatatgcgaattatctacagaactttgttggatacattcaacgaaatagaagaggatatggctaaacaacggagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 194 - DNA, 1647 bp, Artificial Sequence
  CVS mutant V68
atgtcatctggtgaaacttttagaccaactgctgattttcatccatctttgtggagaaatcattttttgcaaggtgcatcagattttaagactgttgatcatacagctacaaatgaaagacatgaagctttgaaggaagaagttagaagaatgattactgatgcagaagatcaaccaattcaaaaattgagattgattgatgaagttcaaagattgggtgttgcttaccattttgaaaaagaaattgaagatgctattcaacaattgtgtccaattcatattgattctgataaagctgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttggggacttattttgaatcacaatacgcttttggtagaaaaatcatgactaaattgaactacattttgtccattattgatgatacctacgatgcttacggtactttggaagaattgtctttgttcagtgaagctgttgctcgttggaacattgaagctgttgacatgttgccagattatatgcgattaatctacagaactttgttggatacattcttggaaatagaagaggatatggctaaacaacggagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 195 - DNA, 1647 bp, Artificial Sequence
  CVS mutant V69
atgtcatctggtgaaacttttagaccaactgctgattttcatccatctttgtggagaaatcattttttgcaaggtgcatcagattttaagactgttgatcatacagctacaaatgaaagacatgaagctttgaaggaagaagttagaagaatgattactgatgcagaagatcaaccaattcaaaaattgagattgattgatgaagttcaaagattgggtgttgcttaccattttgaaaaagaaattgaagatgctattcaacaattgtgtccaattcatattgattctgataaagctgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttggggacttattttgaatcacaatacgcttttggtagaaaaatcatgactaaattgaactacattttgtccattattgatgatacctacgatgcttacggtactttggaagaattgtctttgttcagtgaagctgttgctcgttggaacattgaagctgttgacatgttgccagattatatgaagttaatctacagaactttgttggatacattcaacgaaatagaagaggatatggctaaacaacggagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 196 - DNA, 1647 bp, Artificial Sequence
  CVS mutant V70
atgtcatctggtgaaacttttagaccaactgctgattttcatccatctttgtggagaaatcattttttgcaaggtgcatcagattttaagactgttgatcatacagctacaaatgaaagacatgaagctttgaaggaagaagttagaagaatgattactgatgcagaagatcaaccaattcaaaaattgagattgattgatgaagttcaaagattgggtgttgcttaccattttgaaaaagaaattgaagatgctattcaacaattgtgtccaattcatattgattctgataaagctgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttggggacttattttgaatcacaatacgcttttggtagaaaaatcatgactaaattgaactacattttgtccattattgatgatacctacgatgcttacggtactcacaccgaatgctcgctgttcagtgaagctggcgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 197 - DNA, 1647 bp, Artificial Sequence
  CVS mutant V71
atgtcatctggtgaaacttttagaccaactgctgattttcatccatctttgtggagaaatcattttttgcaaggtgcatcagattttaagactgttgatcatacagctacaaatgaaagacatgaagctttgaaggaagaagttagaagaatgattactgatgcagaagatcaaccaattcaaaaattgagattgattgatgaagttcaaagattgggtgttgcttaccattttgaaaaagaaattgaagatgctattcaacaattgtgtccaattcatattgattctgataaagctgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttggggacttattttgaatcacaatacgcttttggtagaaaaatcatgactaaattgaactacattttgtccattattgatgatacctacgatgcttacggtactttggaagaatgcacgatgttcagtgaagctgttgctcgttggaacattgaagctgttgacatgttgccagattatatgcgattaatctacagaactttgttggatacattcttggaaatagaagaggatatggctaaacaacgtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 198 - DNA, 1647 bp, Artificial Sequence
  CVS mutant V72
atgtcatctggtgaaacttttagaccaactgctgattttcatccatctttgtggagaaatcattttttgcaaggtgcatcagattttaagactgttgatcatacagctacaaatgaaagacatgaagctttgaaggaagaagttagaagaatgattactgatgcagaagatcaaccaattcaaaaattgagattgattgatgaagttcaaagattgggtgttgcttaccattttgaaaaagaaattgaagatgctattcaacaattgtgtccaattcatattgattctgataaagctgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttgggtacttattttgaaccacaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattgataaggttattggtgactattacgttcaagctaagtggttttctgaaggttatgtccctactattgaagaatacatgccaattgctttgacttcttgcgcttacagatttgttattggcaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaaggattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 199 - DNA, 1647 bp, Artificial Sequence
  CVS mutants V73 and V74
atgtcatctggtgaaacttttagaccaactgctgattttcatccatctttgtggagaaatcattttttgcaaggtgcatcagattttaagactgttgatcatacagctacaaatgaaagacatgaagctttgaaggaagaagttagaagaatgattactgatgcagaagatcaaccaattcaaaaattgagattgattgatgaagttcaaagattgggtgttgcttaccattttgaaaaagaaattgaagatgctattcaacaattgtgtccaattcatattgattctgataaagctgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttggggacttattttgaatcacaatacgcttttggtagaaaaatcatgactaaattgaactacattttgtccattattgatgatacctacgatgcttacggtactttggaagaatgcacgatgttcagtgaagctgttgctcgttggaacattgaagctgttgacatgttgccagattatatgcgaataatctacagaactttgttggatacattcttggaaatagaagaggatatggctaaacaacgtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 200 - DNA, 1647 bp, Artificial Sequence
  CVS mutant V77
atgcgggacaagggtacgtgtagaccaactgctgattttcatccatctttgtggagaaatcattttttgcaaggtgcatcagattttaagactgttgatcatacagctacaaatgaaagacatgaagctttgaaggaagaagttagaagaatgattactgatgcagaagatcaaccaattcaaaaattgagattgattgatgaagttcaaagattgggtgttgcttaccattttgaaaaagaaattgaagatgctattcaacaattgtgtccaattcatattgattctgataaagctgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttgggtacttattttgaaccacaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 201 - DNA, 1647 bp, Artificial Sequence
  CVS mutant V78
atggagggaaatagtgtccaaagaccaactgctgattttcatccatctttgtggagaaatcattttttgcaaggtgcatcagattttaagactgttgatcatacagctacaaatgaaagacatgaagctttgaaggaagaagttagaagaatgattactgatgcagaagatcaaccaattcaaaaattgagattgattgatgaagttcaaagattgggtgttgcttaccattttgaaaaagaaattgaagatgctattcaacaattgtgtccaattcatattgattctgataaagctgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttgggtacttattttgaaccacaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtactcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 202 - DNA, 1647 bp, Artificial Sequence
  CVS mutant V79
atgaagcgcgtagggagggcgagaccaactgctgattttcatccatctttgtggagaaatcattttttgcaaggtgcatcagattttaagactgttgatcatacagctacaaatgaaagacatgaagctttgaaggaagaagttagaagaatgattactgatgcagaagatcaaccaattcaaaaattgagattgattgatgaagttcaaagattgggtgttgcttaccattttgaaaaagaaattgaagatgctattcaacaattgtgtccaattcatattgattctgataaagctgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttgggtacttattttgaaccacaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 203 - DNA, 1647 bp, Artificial Sequence
  CVS mutant V228
atgtcatctggtgaaacttttagaccaactgctgattttcatccatctttgtggagaaatcattttttgcaaggtgcatcagattttaagactgttgatcatacagctacaaatgaaagacatgaagctttgaaggaagaagttagaagaatgattttagcaaccggaaggaaaccaattcaaaaattgagattgattgatgaagttcaaagattgggtgttgcttaccattttgaaaaagaaattgaagatgctattcaacaattgtgtccaattcatattgattctgataaagctgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttgggtacttattttgaaccacaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 204 - DNA, 1647 bp, Artificial Sequence
  CVS mutants V80 and V81
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttggatgttgggtacttattttgaaccacaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 205 - DNA, 1647 bp, Artificial Sequence
  CVS mutants V82 and V83
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttggaacttgggtacttattttgaaccacaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 206 - DNA, 1647 bp, Artificial Sequence
  CVS mutant V85
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttggtccttgggtacttattttgaaccacaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 207 - DNA, 1647 bp, Artificial Sequence
  CVS mutant V86
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttggttcttgggtacttattttgaaccacaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 208 - DNA, 1647 bp, Artificial Sequence
  CVS mutants V87 and V88
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttggggattgggtacttattttgaaccacaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 209 - DNA, 1647 bp, Artificial Sequence
  CVS mutant V91
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttggcacttgggtacttattttgaaccacaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 210 - DNA, 1647 bp, Artificial Sequence
  CVS mutant V93
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggagttgggtacttattttgaaccacaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 211 - DNA, 1647 bp, Artificial Sequence
  CVS mutant V89
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttggggcttgggtacttattttgaaccacaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 212 - DNA, 1647 bp, Artificial Sequence
  CVS mutant V90
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttggggtttgggtacttattttgaaccacaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 213 - DNA, 1647 bp, Artificial Sequence
  CVS mutant V94
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttattctgaaccacaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 214 - DNA, 1647 bp, Artificial Sequence
  CVS mutant V97
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttatattgaaccacaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 215 - DNA, 1647 bp, Artificial Sequence
  CVS mutant V99
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttatccggaaccacaatacgcttttggtagaaaaatcatgactaaattaaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 216 - DNA, 1647 bp, Artificial Sequence
  CVS mutant V101
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttatgacgaaccacaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 217 - DNA, 1647 bp, Artificial Sequence
  CVS mutant V102
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttatcttgaaccacaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 218 - DNA, 1647 bp, Artificial Sequence
  CVS mutant V105
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttataatgaaccacaatacgcttttggcagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 219 - DNA, 1647 bp, Artificial Sequence
  CVS mutant V107
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttattttgaatggcaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaataaaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 220 - DNA, 1647 bp, Artificial Sequence
  CVS mutant V108
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttatatggaaccacaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 221 - DNA, 1647 bp, Artificial Sequence
  CVS mutant V109
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttatcacgaaccacaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 222 - DNA, 1647 bp, Artificial Sequence
  CVS mutants V110 and V111
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttattgtgaaccacaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 223 - DNA, 1647 bp, Artificial Sequence
  CVS mutant V95
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttattccgaaccacaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 224 - DNA, 1647 bp, Artificial Sequence
  CVS mutant V112
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttattttgaatggcaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 225 - DNA, 1647 bp, Artificial Sequence
  CVS mutant V113
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttatgctgaaccacaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 226 - DNA, 1647 bp, Artificial Sequence
  CVS mutants V103 and V104
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttatttggaaccacaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 227 - DNA, 1647 bp, Artificial Sequence
  CVS mutant V106
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttataatgaaccacaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 228 - DNA, 1647 bp, Artificial Sequence
  CVS mutant V114
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttatggggaaccacaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 229 - DNA, 1647 bp, Artificial Sequence; identical to SEQ ID NO: 215
  CVS mutant V100

SEQ ID NO: 230 - DNA, 1647 bp, Artificial Sequence
  CVS mutant V115
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttatggagaaccacaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 231 - DNA, 1647 bp, Artificial Sequence
  CVS mutant V116
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttatttcgaaccacaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 232 - DNA, 1647 bp, Artificial Sequence; identical to SEQ ID NO: 223
  CVS mutant V96

SEQ ID NO: 233 - DNA, 1648 bp, Artificial Sequence
  CVS mutant V117
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttatttgggaaccacaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 234 - DNA, 1647 bp, Artificial Sequence
  CVS mutant V118
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttattttgaacatcaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 235 - DNA, 1647 bp, Artificial Sequence
  CVS mutant V119
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttattttgaaaaacaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 236 - DNA, 1647 bp, Artificial Sequence
  CVS mutant V121
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttattttgaagcgcaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 237 - DNA, 1647 bp, Artificial Sequence
  CVS mutant V124
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttattttgaatcacaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 238 - DNA, 1647 bp, Artificial Sequence
  CVS mutant V126
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttattttgaatggcaattcgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 239 - DNA, 1647 bp, Artificial Sequence
  CVS mutant V127
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttattttgaagccccatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 240 - DNA, 1647 bp, Artificial Sequence
  CVS mutant V128
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttattttgaaccccaatacgcttttggtagaaaaatcatgactaaattgaactacattttgtccattattgatgatacctacgatgcttacggtactttggaagaattgtctttgctcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 241 - DNA, 1647 bp, Artificial Sequence
  CVS mutant V129
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttattttctgccacaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 242 - DNA, 1647 bp, Artificial Sequence
  CVS mutants V122 and V123
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttattttgaagcacaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 243 - DNA, 1647 bp, Artificial Sequence
  CVS mutant V131
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttattttgaactgcaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 244 - DNA, 1647 bp, Artificial Sequence
  CVS mutant V135
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttattttgaatatcaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 245 - DNA, 1647 bp, Artificial Sequence
  CVS mutant V120
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttattttgaaaagcaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 246 - DNA, 1647 bp, Artificial Sequence
  CVS mutant 132
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttattttgaacttcaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 247 - DNA, 1647 bp, Artificial Sequence
  CVS mutant V133
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttattttgaaccgcaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 248 - DNA, 1647 bp, Artificial Sequence
  CVS mutant V134
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttattttgaaccccaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 249 - DNA, 1647 bp, Artificial Sequence
  CVS mutant V137
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttattttgaactcccatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 250 - DNA, 1647 bp, Artificial Sequence
  CVS mutant V125
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatacgctagagatagattggttgaattgtacttttgggatttgggtacttattttgaatcacaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 251 - DNA, 1647 bp, Artificial Sequence
  CVS mutants V138 and V139
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttattttgaaccatcatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 252 - DNA, 1647 bp, Artificial Sequence
  CVS mutant V141
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttattttgaaccagcctacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 253 - DNA, 1647 bp, Artificial Sequence
  CVS mutant V143
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttattttgaaccaatctacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 254 - DNA, 1647 bp, Artificial Sequence
  CVS mutant V144
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttattttgaaccacgatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 255 - DNA, 1647 bp, Artificial Sequence
  CVS mutant V146
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttattttgaaccatactacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 256 - DNA, 1647 bp, Artificial Sequence
  CVS mutant V142
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttattttgaaccagcatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 257 - DNA, 1647 bp, Artificial Sequence
  CVS mutant V147
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttattttgaaccactttacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 258 - DNA, 1647 bp, Artificial Sequence; identical to SEQ ID NO: 176
  CVS mutant V140

SEQ ID NO: 259 - DNA, 1647 bp, Artificial Sequence; identical to SEQ ID NO: 180
  CVS mutant V148

SEQ ID NO: 260 - DNA, 1647 bp, Artificial Sequence
  CVS mutant V145
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttattttgaaccacgttacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 261 - DNA, 1647 bp, Artificial Sequence
  CVS mutant V149
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttattttgaaccagggtacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 262 - DNA, 1647 bp, Artificial Sequence
  CVS mutant V150
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttattttgaaccagggtacgcttttggtagaaaaatcatgactaaattgaactacattttgtccattattgatgatacctacgatgcttacggtactttggaagaattgtctttgttcaccgaagctgttgctcgttggagcattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 263 - DNA, 1647 bp, Artificial Sequence
  CVS mutant V151
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttattttgaaccagcgtacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcagcgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 264 - DNA, 1647 bp, Artificial Sequence
  CVS mutant V152
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttattttgaaccatggtacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 265 - DNA, 1647 bp, Artificial Sequence
  CVS mutant V153
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttattttgaaccaccgtacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 266 - DNA, 1647 bp, Artificial Sequence
  CVS mutant V154
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttattttgaaccaccttacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 267 - DNA, 1647 bp, Artificial Sequence
  CVS mutant V155
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttattttgaaccagagtacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 268 - DNA, 1647 bp, Artificial Sequence
  CVS mutant V156
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttattttgaaccacaatacacgtttggtagaaaaatcatgactaaattgaactacattttgtccattattgatgatacctacgatgctcacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 269 - DNA, 1647 bp, Artificial Sequence
  CVS mutant V157
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttattttgaaccacaatacggctttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 270 - DNA, 1647 bp, Artificial Sequence
  CVS mutants V158 and V159
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttattttgaaccacaatacccatttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 271 - DNA, 1647 bp, Artificial Sequence
  CVS mutant V177
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttattttgaaccacaatacgcgtttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 272 - DNA, 1647 bp, Artificial Sequence
  CVS mutant V160
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttattttgaaccacaatacggatttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 273 - DNA, 1647 bp, Artificial Sequence
  CVS mutant V161
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttattttgaaccacaatacgtctttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 274 - DNA, 1647 bp, Artificial Sequence
  CVS mutant V178
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttattttgaaccacggtacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 275 - DNA, 1647 bp, Artificial Sequence
  CVS mutant V162
  variation 903, 1073, 1132, 1158: n = a, c, t or g
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttattttgaaccacaatacggttttggtagaaaaatcatgactaaattgaactacattttgtccattattgangatacctacgatgcgtacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtanatctcattgtgtaagatacgctaaagaagaaattcaaaaggttattggtgcttattacnttcaagctaagtggttttctgaaggntatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 276 - DNA, 1647 bp, Artificial Sequence
  CVS mutant V163
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttattttgaaccacaataccgttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 277 - DNA, 1647 bp, Artificial Sequence
  CVS mutants V165 and V166
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttattttgaaccacaatacgattttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 278 - DNA, 1647 bp, Artificial Sequence
  CVS mutant V167
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttattttgaaccacaatacgagtttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 279 - DNA, 1647 bp, Artificial Sequence
  CVS mutant V168
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttattttgaaccacaaaactcctttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 280 - DNA, 1647 bp, Artificial Sequence
  CVS mutant V164
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttattttgaaccacaatacaggtttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 281 - DNA, 1647 bp, Artificial Sequence
  CVS mutant V169
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttattttgaaccacaataccactttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 282 - DNA, 1647 bp, Artificial Sequence
  CVS mutant V170
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttattttgaaccacaatacaagtttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 283 - DNA, 1646 bp, Artificial Sequence
  CVS mutant V171
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttattttgaaccacaatacatcttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 284 - DNA, 1647 bp, Artificial Sequence
  CVS mutant V172
  variation (1024)...(1025): n = a, c, g or t
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttattttgaaccacaatactggtttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactnngttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 285 - DNA, 1647 bp, Artificial Sequence
  CVS mutant V173
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttattttgaaccacaatacacctttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 286 - DNA, 1647 bp, Artificial Sequence
  CVS mutant V175
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttattttgaaccacaatacgcatttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 287 - DNA, 1647 bp, Artificial Sequence
  CVS mutant V174
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttattttgaaccacaatacatgtttggtagaaaaatcatgactaaattgaactacattttgtccattattgatgatacctacgatgcttacggtactttggaagaattgtctttgttcaccgaagctgttgctcgtcggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 288 - DNA, 1647 bp, Artificial Sequence
  CVS mutant V176
atgtcatctggtgaaacttttagaccaactgctgattttcatccatctttgtggagaaatcattttttggctggtgcatcagattttaagactgttgatcatacagctacagctgaaagacatgaagctttgaaggaagaagttagaagaatgattactgatgcagaagatgctccaattcaaaaattgagattgattgatgaagttcaaagattgggtgttgcttaccattttgaaaaagaaattgaagatgctattcaagctttgtgtccaattcatattgattctgataaagctgatttgcatactgtttctttgcatttcagattgttgagacaacaaggtattaagatttcttgtgatgttttcgaagcttttaaggatgatgaaggtagattcaaaagttctttgattaatgatgttcaaggcatgttgtctttgtatgaagctgcttatatggctgttagaggtgaacatattttggatgaagctattgcatttactactactcatttggcttcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtgggctgatttggattttactactaaattgccatatgctagagatagattggttgaattgtacttttgggatttgggtacttattttgaaccacaatacgcctttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 289 - protein, 548 aa, Citrus sinensis
  Citrus valencene synthase
  ref <308>: DATABASE ACCESSION NUMBER: Genbank Accession No. AAQ04608
MSSGETFRPTADFHPSLWRNHFLKGASDFKTVDHTATQERHEALKEEVRRMITDAEDKPVQKLRLIDEVQRLGVAYHFEKEIGDAIQKLCPIYIDSNRADLHTVSLHFRLLRQQGIKISCDVFEKFKDDEGRFKSSLINDVQGMLSLYEAAYMAVRGEHILDEAIAFTTTHLKSLVAQDHVTPKLAEQINHALYRPLRKTLPRLEARYFMSMINSTSDHLCNKTLLNFAKLDFNILLELHKEELNELTKWWKDLDFTTKLPYARDRLVELYFWDLGTYFEPQYAFGRKIMTQLNYILSIIDDTYDAYGTLEELSLFTEAVQRWNIEAVDMLPEYMKLIYRTLLDAFNEIEEDMAKQGRSHCVRYAKEENQKVIGAYSVQAKWFSEGYVPTIEEYMPIALTSCAYTFVITNSFLGMGDFATKEVFEWISNNPKVVKAASVICRLMDDMQGHEFEQKRGHVASAIECYTKQHGVSKEEAIKMFEEEVANAWKDINEELMMKPTVVARPLLGTILNLARAIDFIYKEDDGYTHSYLIKDQIASVLGDHVPF

SEQ ID NO: 290 - protein, 548 aa, Citrus x paradisi
  Citrus valencene synthase
MSSGETFRPTADFHPSLWRNHFLKGASDFKTVDHTATQERHEALKEEVRRMITDAEDKPVQKLRLIDEVQRLGVAYHFEKEIEDAILKLCPIYIDSNRADLHTVSLHFRLLRQQGIKISCDVFEKFKDDEGRFKSSLINDVQGMLSLYEAAYMAVRGEHILDEAIAFTTTHLKSLVAQDHVTPKLAEQINHALYRPLRKTLPRLEARYFMSMINSTSDHLYNKTLLNFAKLDFNILLEPHKEELNELTKWWKDLDFTTKLPYARDRLVELYFWDLGTYFEPQYAFGRKIMTQLNYILSIIDDTYDAYGTLEELSLFTEAVQRWNIEAVDMLPEYMKLIYRTLLDAFNEIEEDMAKQGRSHCVRYAKEENQKVIGAYSVQAKWFSEGYVPTIEEYMPIALTSCAYTFVITNSFLGMGDFATKEVFEWISNNPKVVKAASVICRLMDDMQGHEFEQKRGHVASAIECYTKQHGVSKEEAIKMFEEEVANAWKDINEELMMKPTVVARPLLGTILNLARAIDFIYKEDDGYTHSYLIKDQIASVLGDHVPF

SEQ ID NO: 291 - protein, 548 aa, Citrus x paradisi
  Citrus valencene synthase
  ref <308>: DATABASE ACCESSION NUMBER: Genbank Accession No. AAM00426
MSSGETFRPTADFHPSLWRNHFLKGASDFKTVDHTATQERHEALKEEVRRMITDAEDKPVQKLRLIDEVQRLGVAYHFEKEIEDAILKLCPIYIDSNRADLHTVSLHFRLLRQQGIKISCDVFEKFKDDEGRFKSSLINDVQGMLSLYEAAYMAVRGEHILDEAIAFTTTHLKSLVAQDHVTPKLAEQINHALYRPLRKTLPRLEARYFMSMINSTSDHLYNKTLLNFAKLDFNILLEPHKEELNELTKWWKDLDFTTKLPYARDRLVELYFWDLGTYFEPQYAFGRKIMTQLNYILSIIDDTYDAYGTLEELSLFTEAVQRWNIEAVDMLPEYMKLIYRTLLDAFNEIEEDMAKQGRSHCVRYAKEENQKVIGAYSVQAKWFSEGYVPTIEEYMPIALTSCAYTFVITNSFLGMGDFATKEVFEWISNNPKVVKAASVICRLMDDMQGHEFEQKRGHVASAIECYTKQHGVSKEEAIKMFEEEVANAWKDIDEELMMKPTVVARPLLGTILNLARAIDFIYKEDDGYTHSYLIKDQIASVLGDHVPF

SEQ ID NO: 292 - DNA, 1647 bp, Citrus sinensis
  Citrus valencene synthase
  ref <308>: DATABASE ACCESSION NUMBER: Genbank Accession No. AF441124
atgtcgtctggagaaacatttcgtcctactgcagatttccatcctagtttatggagaaaccatttcctcaaaggtgcttctgatttcaagacagttgatcatactgcaactcaagaacgacacgaggcactgaaagaagaggtaaggagaatgataacagatgctgaagataagcctgttcagaagttacgcttgattgatgaagtacaacgcctgggggtggcttatcactttgagaaagaaataggagatgcaatacaaaaattatgtccaatctatattgacagtaatagagctgatctccacaccgtttcccttcattttcggttgcttaggcagcaaggaatcaagatttcatgtgatgtgtttgagaagttcaaagatgatgagggtagattcaagtcatcgttgataaacgatgttcaagggatgttaagtttgtacgaggcagcatacatggcagttcgcggagaacatatattagatgaagccattgctttcactaccactcacctgaagtcattggtagctcaggatcatgtaacccctaagcttgcggaacagataaatcatgctttataccgtcctcttcgtaaaaccctaccaagattagaggcgaggtattttatgtccatgatcaattcaacaagtgatcatttatgcaataaaactctgctgaattttgcaaagttagattttaacatattgctagagctgcacaaggaggaactcaatgaattaacaaagtggtggaaagatttagacttcactacaaaactaccttatgcaagagacagattagtggagttatatttttgggatttagggacatacttcgagcctcaatatgcatttgggagaaagataatgacccaattaaattacatattatccatcatagatgatacttatgatgcgtatggtacacttgaagaactcagcctctttactgaagcagttcaaagatggaatattgaggccgtagatatgcttccagaatacatgaaattgatttacaggacactcttagatgcttttaatgaaattgaggaagatatggccaagcaaggaagatcacactgcgtacgttatgcaaaagaggagaatcaaaaagtaattggagcatactctgttcaagccaaatggttcagtgaaggttacgttccaacaattgaggagtatatgcctattgcactaacaagttgtgcttacacattcgtcataacaaattccttccttggcatgggtgattttgcaactaaagaggtttttgaatggatctccaataaccctaaggttgtaaaagcagcatcagttatctgcagactcatggatgacatgcaaggtcatgagtttgagcagaagagaggacatgttgcgtcagctattgaatgttacacgaagcagcatggtgtctctaaggaagaggcaattaaaatgtttgaagaagaagttgcaaatgcatggaaagatattaacgaggagttgatgatgaagccaaccgtcgttgcccgaccactgctcgggacgattcttaatcttgctcgtgcaattgattttatttacaaagaggacgacggctatacgcattcttacctaattaaagatcaaattgcttctgtgctaggagaccacgttccattttga

SEQ ID NO: 293 - DNA, 1647 bp, Citrus x paradisi
  Citrus valencene synthase
atgtcgtctggagaaacatttcgtcctactgcagatttccatcctagtttatggagaaaccatttcctcaaaggtgcttctgatttcaagacagttgatcatactgcaactcaagaacgacacgaggcactgaaagaagaggtaaggagaatgataacagatgctgaagataagcctgttcagaagttacgcttgattgatgaagtacaacgcctgggggtggcttatcactttgagaaagaaatagaagatgcaatactaaaattatgtccaatctatattgacagtaatagagctgatctccacaccgtttcccttcattttcgattgcttaggcagcaaggaatcaagatttcatgtgatgtgtttgagaagttcaaagatgatgagggtagattcaagtcatcgttgataaacgatgttcaagggatgttaagtttgtacgaggcagcatacatggcagttcgcggagaacatatattagatgaagccattgctttcactaccactcacctgaagtcattggtagctcaggatcatgtaacccctaagcttgcggaacagataaatcatgctttataccgtcctcttcgtaaaaccctaccaagattagaggcgaggtattttatgtccatgatcaattcaacaagtgatcatttatacaataaaactctgctgaattttgcaaagttagattttaacatattgctagagccgcacaaggaggaactcaatgaattaacaaagtggtggaaagatttagacttcactacaaaactaccttatgcaagagacagattagtggagttatatttttgggatttagggacatacttcgagcctcaatatgcatttgggagaaagataatgacccaattaaattacatattatccatcatagatgatacttatgatgcgtatggtacacttgaagaactcagcctctttactgaagcagttcaaagatggaatattgaggccgtagatatgcttccagaatacatgaaattgatttacaggacactcttagatgcttttaatgaaattgaggaagatatggccaagcaaggaagatcacactgcgtacgttatgcaaaagaggagaatcaaaaagtaattggagcatactctgttcaagccaaatggttcagtgaaggttacgttccaacaattgaggagtatatgcctattgcactaacaagttgtgcttacacattcgtcataacaaattccttccttggcatgggtgattttgcaactaaagaggtttttgaatggatctccaataaccctaaggttgtaaaagcagcatcagttatctgcagactcatggatgacatgcaaggtcatgagtttgagcagaagagaggacatgttgcgtcagctattgaatgttacacgaagcagcatggtgtctctaaggaagaggcaattaaaatgtttgaagaagaagttgcaaatgcatggaaagatattaacgaggagttgatgatgaagccaaccgtcgttgcccgaccactgctcgggacgattcttaatcttgctcgtgcaattgattttatttacaaagaggacgacggctatacgcattcttacctaattaaagatcaaattgcttctgtgctaggagaccacgttccattttga

SEQ ID NO: 294 - DNA, 1877 bp, Citrus x paradisi
  Citrus valencene synthase
  ref <308>: DATABASE ACCESSION NUMBER: Genbank Accession No. AF411120
aatacaaattataattccacagaaatatcaaaattctgcggcacccgtttgtctgacacaaaaatgtcgtctggagaaacatttcgtcctactgcagatttccatcctagtttatggagaaaccatttcctcaaaggtgcttctgatttcaagacagttgatcatactgcaactcaagaacgacacgaggcactgaaagaagaggtaaggagaatgataacagatgctgaagataagcctgttcagaagttacgcttgattgatgaagtacaacgcctgggggtggcttatcactttgagaaagaaatagaagatgcaatactaaaattatgtccaatctatattgacagtaatagagctgatctccacaccgtttcccttcattttcgattgcttaggcagcaaggaatcaagatttcatgtgatgtgtttgagaagttcaaagatgatgagggtagattcaagtcatcgttgataaacgatgttcaagggatgttaagtttgtacgaggcagcatacatggcagttcgcggagaacatatattagatgaagccattgctttcactaccactcacctgaagtcattggtagctcaggatcatgtaacccctaagcttgcggaacagataaatcatgctttataccgtcctcttcgtaaaaccctaccaagattagaggcgaggtattttatgtccatgatcaattcaacaagtgatcatttatacaataaaactctgctgaattttgcaaagttagattttaacatattgctagagccgcacaaggaggaactcaatgaattaacaaagtggtggaaagatttagacttcactacaaaactaccttatgcaagagacagattagtggagttatatttttgggatttagggacatacttcgagcctcaatatgcatttgggagaaagataatgacccaattaaattacatattatccatcatagatgatacttatgatgcgtatggtacacttgaagaactcagcctctttactgaagcagttcaaagatggaatattgaggccgtagatatgcttccagaatacatgaaattgatttacaggacactcttagatgcttttaatgaaattgaggaagatatggccaagcaaggaagatcacactgcgtacgttatgcaaaagaggagaatcaaaaagtaattggagcatactctgttcaagccaaatggttcagtgaaggttacgttccaacaattgaggagtatatgcctattgcactaacaagttgtgcttacacattcgtcataacaaattccttccttggcatgggtgattttgcaactaaagaggtttttgaatggatctccaataaccctaaggttgtaaaagcagcatcagttatctgcagactcatggatgacatgcaaggtcatgagtttgagcagaagagaggacatgttgcgtcagctattgaatgttacacgaagcagcatggtgtctctaaggaagaggcaattaaaatgtttgaagaagaagttgcaaatgcatggaaagatattgacgaggagttgatgatgaagccaaccgtcgttgcccgaccactgctcgggacgattcttaatcttgctcgtgcaattgattttatttacaaagaggacgacggctatacgcattcttacctaattaaagatcaaattgcttctgtgctaggagaccacgttccattttgacgactagttctatacttctattaataatattttcagttccttggtttgtgtttaaaggaaatacggtgtatcgtattggtctgtactaataaatattttatatttttattgttacttaaagattttcccttcgaataaaaaaataaactctaatataaaaaaaaaaa

SEQ ID NO: 295 - protein, 548 aa, Nicotiana tabacum
  Tobacco 5-epi-aristolochene synthase
MASAAVANYEEEIVRPVADFSPSLWGDQFLSFSIKNQVAEKYAKEIEALKEQTRNMLLATGMKLADTLNLIDTIERLGISYHFEKEIDDILDQIYNQNSNCNDLCTSALQFRLLRQHGFNISPEIFSKFQDENGKFKESLASDVLGLLNLYEASHVRTHADDILEDALAFSTIHLESAAPHLKSPLREQVTHALEQCLHKGVPRVETRFFISSIYDKEQSKNNVLLRFAKLDFNLLQMLHKQELAQVSRWWKDLDFVTTLPYARDRVVECYFWALGVYFEPQYSQARVMLVKTISMISIVDDTFDAYGTVKELEAYTDAIQRWDINEIDRLPDYMKISYKAILDLYKDYEKELSSAGRSHIVCHAIERMKEVVRNYNVESTWFIEGYTPPVSEYLSNALATTTYYYLATTSYLGMKSATEQDFEWLSKNPKILEASVIICRVIDDTATYEVEKSRGQIATGIECCMRDYGISTKEAMAKFQNMAETAWKDINEGLLRPTPVSTEFLTPILNLARIVEVTYIHNLDGYTHPEKVLKPHIINLLVDSIKI

SEQ ID NO: 296 - protein, 520 aa, Hyoscyamus muticus
  Hyoscyamus muticus premnaspirodiene synthase
VDNQVAEKYAQEIETLKEQTSTMLSAACGTTLTEKLNLIDIIERLGIAYHFEKQIEDMLDHIYRADPYFEAHEYNDLNTSSVQFRLLRQHGYNVSPNIFSRFQDANGKFKESLRSDIRGLLNLYEASHVRTHKEDILEEALVFSVGHLESAAPHLKSPLSKQVTHALEQSLHKSIPRVEIRYFISIYEEEEFKNDLLLRFAKLDYNLLQMLHKHELSEVSRWWKDLDFVTTLPYARDRAVECYFWTMGVYAEPQYSQARVMLAKTIAMISIVDDTFDAYGIVKELEVYTDAIQRWDISQIDRLPEYMKISYKALLDLYDDYEKELSKDGRSDVVHYAKERMKEIVGNYFIEGKWFIEGYMPSVSEYLSNALATSTYYLLTTTSYLGMKSATKEHFEWLATNPKILEANATLCRVVDDIATYEVEKGRGQIATGIECYMRDYGVSTEVAMEKFQEMADIAWKDVNEEILRPTPVSSEILTRILNLARIIDVTYKHNQDGYTHPEKVLKPHIIALVVDSIDI

SEQ ID NO: 297 - DNA, 23 bp, Artificial Sequence
  primer 11-157.7
aaggtaccatttaaaaaaatgtc

SEQ ID NO: 298 - DNA, 23 bp, Artificial Sequence
  primer 11-157.8
tttctctagattaaaatggaaca

SEQ ID NO: 299 - DNA, 51 bp, Artificial Sequence
  primer 21-73-1
aaattgccatatgctagagatagattggttgaattgtacttttgggatttg

SEQ ID NO: 300 - DNA, 51 bp, Artificial Sequence
  primer 21-73-2
aaattgccatatgctagagatagacttgttgaattgtacttttgggatttg

SEQ ID NO: 301 - DNA, 58 bp, Artificial Sequence
  primer 21-73-3
gatttttctaccaaaagcgtattgtgrttcaaaataagtmcccaaatcccaaaagtac

SEQ ID NO: 302 - DNA, 58 bp, Artificial Sequence
  primer 21-73-4
gatttttctaccaaaagcgtaagatgrttcaaaataagtmcccaaatcccaaaagtac

SEQ ID NO: 303 - DNA, 58 bp, Artificial Sequence
  primer 21-73-5
gatttttctaccaaaagcgtacagtgrttcaaaataagtmcccaaatcccaaaagtac

SEQ ID NO: 304 - DNA, 66 bp, Artificial Sequence
  primer 21-73-6
cttttggtagaaaaatcatgactaaattgaactacattttgtccattattgatgatacctacgatg

SEQ ID NO: 305 - DNA, 66 bp, Artificial Sequence
  primer 21-73-7
cttttggtagaaaaatcatgactaaattgaactacattttgtcctacattgatgatacctacgatg

SEQ ID NO: 306 - DNA, 48 bp, Artificial Sequence
  primer 21-73-8
gaacaaagacaattcttccaaagtaccgtaagcatcgtaggtatcatc

SEQ ID NO: 307 - DNA, 51 bp, Artificial Sequence
  primer 21-73-9
ggtgaacaaagacaattcttcgtgagtaccgtaagcatcgtaggtatcatc

SEQ ID NO: 308 - DNA, 51 bp, Artificial Sequence
  primer 21-73-10
ggtgaacaaagacaattcggkcaaagtaccgtaagcatcgtaggtatcatc

SEQ ID NO: 309 - DNA, 51 bp, Artificial Sequence
  primer 21-73-11
ggtgaacaaagacaattcggkgtgagtaccgtaagcatcgtaggtatcatc

SEQ ID NO: 310 - DNA, 36 bp, Artificial Sequence
  primer 21-73-12
ttcttccaaagtaccgtaagcatcgtaggtatcatc

SEQ ID NO: 311 - DNA, 39 bp, Artificial Sequence
  primer 21-73-13
caattcttccaaagtaccgtaagcatcgtaggtatcatc

SEQ ID NO: 312 - DNA, 60 bp, Artificial Sequence
  primer 21-73-14
rtcagcttcactgaacakcgwgcattcggkgtgagtaccgtaagcatcgtaggtatcatc

SEQ ID NO: 313 - DNA, 60 bp, Artificial Sequence
  primer 21-73-15
vccagcttcactgaacakcgwgcattcggkgtgagtaccgtaagcatcgtaggtatcatc

SEQ ID NO: 314 - DNA, 47 bp, Artificial Sequence
  primer 21-73-16
gaattgtctttgttcaccgaagctgttgctcgttggaacattgaagc

SEQ ID NO: 315 - DNA, 59 bp, Artificial Sequence
  primer 21-73-17
ggtactttggaagaattgwcgmtgttcaccgaagctgttgctcgttggaacattgaagc

SEQ ID NO: 316 - DNA, 64 bp, Artificial Sequence
  primer 21-73-18
cttacggtactttggaagaatgcwcgmtgttcaccgaagctgttgctcgttggaacattgaagc

SEQ ID NO: 317 - DNA, 64 bp, Artificial Sequence
  primer 21-73-19
cttacggtactttggaagaatgcwcgmtgttctcagaagctgttgctcgttggaacattgaagc

SEQ ID NO: 318 - DNA, 64 bp, Artificial Sequence
  primer 21-73-20
cttacggtactttggaagaatgcwcgmtgttcagtgaagctgttgctcgttggaacattgaagc

SEQ ID NO: 319 - DNA, 50 bp, Artificial Sequence
  primer 21-73-21
gaagaattgtctttgttctcagaagctgaygctcgttggaacattgaagc

SEQ ID NO: 320 - DNA, 50 bp, Artificial Sequence
  primer 21-73-22
gaagaattgtctttgttctcagaagctggbgctcgttggaacattgaagc

SEQ ID NO: 321 - DNA, 50 bp, Artificial Sequence
  primer 21-73-23
gaagaattgtctttgttcagtgaagctgaygctcgttggaacattgaagc

SEQ ID NO: 322 - DNA, 50 bp, Artificial Sequence
  primer 21-73-24
gaagaattgtctttgttcagtgaagctggbgctcgttggaacattgaagc

SEQ ID NO: 323 - DNA, 50 bp, Artificial Sequence
  primer 21-73-25
gaagaattgtctttgttcagtgaagctgttgctcgttggaacattgaagc

SEQ ID NO: 324 - DNA, 50 bp, Artificial Sequence
  primer 21-73-26
gaagaattgtctttgttctcagaagctgttgctcgttggaacattgaagc

SEQ ID NO: 325 - DNA, 50 bp, Artificial Sequence
  primer 21-73-27
gaagaattgtctttgttcaccgaagctgaygctcgttggaacattgaagc

SEQ ID NO: 326 - DNA, 50 bp, Artificial Sequence
  primer 21-73-28
gaagaattgtctttgttcaccgaagctggbgctcgttggaacattgaagc

SEQ ID NO: 327 - DNA, 53 bp, Artificial Sequence
  primer 21-73-29
cacmccgaatgcwcgmtgttcagtgaagctggbgctcgttggaacattgaagc

SEQ ID NO: 328 - DNA, 53 bp, Artificial Sequence
  primer 21-73-30
cacmccgaatgcwcgmtgttcagtgaagctgaygctcgttggaacattgaagc

SEQ ID NO: 329 - DNA, 60 bp, Artificial Sequence
  primer 21-73-31
tctgtagattaacttcatataatctggcaacatgtcaacagcttcaatgttccaacgagc

SEQ ID NO: 330 - DNA, 60 bp, Artificial Sequence
  primer 21-73-32
tctgtagatwawtcgcatataatctggcaacatgtcaacagcttcaatgttccaacgagc

SEQ ID NO: 331 - DNA, 60 bp, Artificial Sequence
  primer 21-73-33
atatgaagttaatctacagaactttgttggatacattcaacgaaatagaagaggatatgg

SEQ ID NO: 332 - DNA, 60 bp, Artificial Sequence
  primer 21-73-34
atatgaagwtwatctacagaactttgttggatacattcttggaaatagaagaggatatgg

SEQ ID NO: 333 - DNA, 60 bp, Artificial Sequence
  primer 21-73-35
atatgcgawtwatctacagaactttgttggatacattcaacgaaatagaagaggatatgg

SEQ ID NO: 334 - DNA, 60 bp, Artificial Sequence
  primer 21-73-36
atatgcgawtwatctacagaactttgttggatacattcttggaaatagaagaggatatgg

SEQ ID NO: 335 - DNA, 42 bp, Artificial Sequence
  primer 21-73-37
acaatgagatctmcgttgtttagccatatcctcttctatttc

SEQ ID NO: 336 - DNA, 42 bp, Artificial Sequence
  primer 21-73-38
acaatgagatctaccttgtttagccatatcctcttctatttc

SEQ ID NO: 337 - DNA, 59 bp, Artificial Sequence
  mutCVS2-7
  variation (23)...(40): n = a, c, t or g
ctcggtaccatttaaaaaaatgnnnnnnnnnnnnnnnnnnagaccaactgctgattttc

SEQ ID NO: 338 - DNA, 20 bp, Artificial Sequence
  primer 7-10.3
ccaagctgaattcgagctcg

SEQ ID NO: 339 - DNA, 20 bp, Artificial Sequence
  primer 7-10.4
acttgaccaaacctctggcg

SEQ ID NO: 340 - DNA, 48 bp, Artificial Sequence
  primer 21-108-1
  variation (16)...(33): n = a, c, g or t
gttagaagaatgattnnnnnnnnnnnnnnnnnnccaattcaaaaattg

SEQ ID NO: 341 - DNA, 48 bp, Artificial Sequence
  primer 21-108-2
  variation (16)...(33): n = a, c, t or g
caatttttgaattggnnnnnnnnnnnnnnnnnnaatcattcttctaac

SEQ ID NO: 342 - DNA, 48 bp, Artificial Sequence
  primer 21-108-3
gttagaagaatgattttagcaaccggaaggaaaccaattcaaaaattg

SEQ ID NO: 343 - DNA, 48 bp, Artificial Sequence
  primer 21-108-4
caatttttgaattggtttccttccggttgctaaaatcattcttctaac

SEQ ID NO: 344 - DNA, 21 bp, Artificial Sequence
  CVSpcrF1
cattcacgcacactactctct

SEQ ID NO: 345 - DNA, 20 bp, Artificial Sequence
  CVSpcrR1
gccgacaaccttgattggag

SEQ ID NO: 346 - protein, 556 aa, Vitis vinifera
  Valencene Synthase
  ref <308>: DATABASE ACCESSION NUMBER: Uniprot Acc. No. C1JXK7
MSTQVSASSLAQIPQPKNRPVANFHPNIWGDQFITYTPEDKVTRACKEEQIEDLKKEVKRKLTAAAVANPSQLLNFIDAVQRLGVAYHFEQEIEEALQHICNSFHDCNDMDGDLYNIALGFRLLRQQGYTISCDIFNKFTDERGRFKEALISDVRGMLGLYEAAHLRVHGEDILAKALAFTTTHLKAMVESLGYHLAEQVAHALNRPIRKGLERLEARWYISVYQDEAFHDKTLLELAKLDFNLVQSLHKEELSNLARWWKELDFATKLPFARDRLVEGYFWMHGVYFEPQYLRGRRILTKVIAMTSILDDIHDAYGTPEELKLFIEAIERWDINSINQLPEYMKLCYVALLDVYKEIEEEMEKEGNQYRVHYAKEVMKNQVRAYFAEAKWLHEEHVPAFEEYMRVALASSGYCLLATTSFVGMGEIATKEAFDWVTSDPKIMSSSNFITRLMDDIKSHKFEQKRGHVASAVECYMKQYGVSEEQVYSEFQKQIENAWLDINQECLKPTAVSMPLLARLLNLTRTMDVIYKEQDSYTHVGKVMRDNIASVFINAVI

SEQ ID NO: 347 - protein, 556 aa, Vitis vinifera
  Valencene Synthase
  ref <308>: DATABASE ACCESSION NUMBER: Uniprot Acc. No. Q6Q3H2
MSTQVSASSLAQIPQPKNRPVANFHPNIWGDQFITYTPEDKVTRACKEEQIEDLKKEVKRKLTAAAVANPSQLLNFIDAVQRLGVAYHFEQEIEEALQHICNSFHDCNDMDGDLYNIALGFRLLRQQGYTISCDIFNKFTDERGRFKEALISDVRGMLGLYEAAHLRVHGEDILAKALAFTTTHLKAMVESLGYHLAEQVAHALNRPIRKGLERLEARWYISVYQDEAFHDKTLLELAKLDFNLVQSLHKEELSNLARWWKELDFATKLPFARDRLVEGYFWMHGVYFEPQYLRGRRILTKVIAMTSILDDIHDAYGTPEELKLFIEAIERWDINSINQLPEYMKLCYVALLDVYKEIEEEMEKEGNQYRVHYAKEVMKNQVRAYFAEAKWLHEEHVPAFEEYMRVALASSGYCLLATTSFVGMGEIATKEAFDWVTSDPKIMSSSNFITRLMDDIKSHKFEQKRGHVTSAVECYMKQYGVSEEQVYSEFQKQIENAWLDINQECLKPTAVSMPLLARLLNFTRTMDVIYKEQDSYTHVGKVMRDNIASVFINAVI

SEQ ID NO: 348 - protein, 548 aa, Artificial Sequence
  CVS mutant V11
MSSGETFRPTADFHPSLWRNHFLKGASDFKTVDHTATQERHEALKEEVRRMITDAEDKPVQKLRLIDEVQRLGVAYHFEKEIEDAIQKLCPIYIDSNKADLHTVSLHFRLLRQQGIKISCDVFEKFKDDEGRFKSSLINDVQGMLSLYEAAYMAVRGEHILDEAIAFTTTHLKSLVAQDHVTPKLAEQINHALYRPLRKTLPRLEARYFMSMIDSTSDHLYNKTLLSFAKLDFNILLELHKEELNELTKWWKDLDFTTKLPYARDRLVELYFWDLGTYFEPQYAFGRKIMTQLNYILSIIDDTYDAYGTLEELSLFTEAVQRWNIEAVDMLPEYMKLIYRTLLDAFNEIEEDMAKQGRSHCVRYAKEENQKVIGAYSVQAKWFSEGYVPTIEEYMPIALTSCAYRFVITNSFLGMGDFATKEVFEWISNNPKVVKAASVICRLMDDMQGHEFEQKRGHVASAIECYTKQHGVSKEEAIKMFEEEVANAWKDINEELMMKPTVVARPLLGTILNLARAIDFIYKEDDGYTHSYLIKDQIASVLGDHVPF

SEQ ID NO: 349 - DNA, 1647 bp, Artificial Sequence
  CVS mutant V11
atgtcgtctggagaaacatttcgtcctactgcagatttccatcctagtttatggagaaaccatttcctcaaaggtgcttctgatttcaagacagttgatcatactgcaactcaagaacgacacgaggcactgaaagaagaggtaagaagaatgataacagatgctgaagataagcctgttcagaagttacgcttgattgatgaagtacaacgcctgggggtggcttatcactttgagaaagaaatagaagatgcaatacaaaaattatgtccaatctatattgacagtaataaagctgatctccacaccgtttcccttcattttcgattgcttaggcagcaaggaatcaagatttcatgtgatgtgtttgagaagttcaaagatgatgagggtagattcaagtcatcgttgataaacgatgttcaagggatgttaagtttgtacgaggcagcatacatggcagttcgcggagaacatatattagatgaagccattgctttcactaccactcacctgaagtcattggtagctcaggatcatgtaacccctaagcttgcagaacagataaatcatgctttataccgtcctcttcgtaaaaccctaccaagattagaggcgaggtattttatgtccatgatcgattcaacaagtgatcatttatacaataaaactctgctgagttttgcaaagttagattttaacatattgctagagctgcacaaggaggaactcaatgaattaacaaagtggtggaaagatttagacttcactacaaaactaccttatgcaagagacagattagtggagttatatttttgggatttagggacatacttcgagcctcaatatgcatttgggagaaagataatgacccaattaaattacatattatccatcatagatgatacttatgatgcgtatggtacacttgaagaactcagcctctttactgaagcagttcaaagatggaatattgaggccgtagatatgcttccagaatacatgaaattgatttacaggacactcttagatgcttttaatgaaattgaggaagatatggccaagcaaggaagatcacactgcgtacgttatgcaaaagaggagaatcaaaaagtaattggagcatactctgttcaagccaaatggttcagtgaaggttacgttccaacaattgaggagtatatgcctattgcactaacaagttgtgcttacagattcgtcataacaaattccttccttggcatgggtgattttgcaactaaagaggtttttgaatggatctccaataaccctaaggttgtaaaagcagcatcagttatctgcagactcatggatgacatgcaaggtcatgagtttgagcagaagagaggacatgttgcgtcagctattgaatgttacacgaagcagcatggtgtctctaaggaagaggcaattaaaatgtttgaagaagaagttgcaaatgcatggaaagatattaacgaggagttgatgatgaagccaaccgtcgttgcccgaccactgctcgggacgattcttaatcttgctcgtgcaattgattttatttacaaagaggacgacggctatacgcattcttacctaattaaagatcaaattgcttctgtgctaggagaccacgttccattttga

SEQ ID NO: 350 - protein, 548 aa, Artificial Sequence
  CVS variant V229
MSSGETFRPTADFHPSLWRNHFLQGASDFKTVDHTATNERHEALKEEVRRMILATGRKPIQKLRLIDEVQRLGVAYHFEKEIEDAIQQLCPIHIDSDKADLHTVSLHFRLLRQQGIKISCDVFEQFKDDEGRFKSSLINDVQGMLSLYEAAYMAVRGEHILDEAIAFTTTHLQSLVAQDHVTPRLAEQINHALYRPLRKTLPRLEARYIMSRIDSTSDDLVNKTLLNFAKLDFNILLDLHKEELNELTKWWQDLDFTTKLPYARDRLVELYFWDLGTYFESQYAFGRKIMTKLNYILSIIDDTYDAYGTLEECTMFSEAVARWNIEAVDMLPDYMRIIYRTLLDTFLEIEEDMAKQRRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 351 - protein, 547 aa, Artificial Sequence
  CVS variant V230 and V231
MSSGETFRPTADFHPSLWRNHFLQGASDFKTVDHTATNERHEALKEEVRRMILATGRKPIQKLRLIDEVQRLGVAYHFEKEIEDAIQQLCPIHIDSDKADLHTVSLHFRLLRQQGIKISCDVFEQFKDDEGRFKSSLINDVQGMLSLYEAAYMAVRGEHILDEAIAFTTTHLQSLVAQDHVTPRLAEQINHALYRPLRKTLPRLEARYIMSRIDSTSDDLVNKTLLNFAKLDFNILLDLHKEELNELTKWWQDLDFTTKLPYARDRLVELYFWDLGTYFESQYAFGRKIMTKLNYILSIIDDTYDAYGTLEECTMFSEAVARWNIEAVDMLPDYMRIIYRTLLDTFNEIEEDMAKQRRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVP

SEQ ID NO: 352 - DNA, 1647 bp, Artificial Sequence
  CVS variant V229
atgtcatctggtgaaacttttagaccaactgctgattttcatccatctttgtggagaaatcattttttgcaaggtgcatcagattttaagactgttgatcatacagctacaaatgaaagacatgaagctttgaaggaagaagttagaagaatgattttagcaaccggaaggaaaccaattcaaaaattgagattgattgatgaagttcaaagattgggtgttgcttaccattttgaaaaagaaattgaagatgctattcaacaattgtgtccaattcatattgattctgataaagctgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttggggacttattttgaatcacaatacgcttttggtagaaaaatcatgactaaattgaactacattttgtccattattgatgatacctacgatgcttacggtactttggaagaatgcacgatgttcagtgaagctgttgctcgttggaacattgaagctgttgacatgttgccagattatatgcgaataatctacagaactttgttggatacattcttggaaatagaagaggatatggctaaacaacgtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 353 - DNA, 1647 bp, Artificial Sequence
  CVS variant V230 and V231
atgtcatctggtgaaacttttagaccaactgctgattttcatccatctttgtggagaaatcattttttgcaaggtgcatcagattttaagactgttgatcatacagctacaaatgaaagacatgaagctttgaaggaagaagttagaagaatgattttagcaaccggaaggaaaccaattcaaaaattgagattgattgatgaagttcaaagattgggtgttgcttaccattttgaaaaagaaattgaagatgctattcaacaattgtgtccaattcatattgattctgataaagctgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttggggacttattttgaatcacaatacgcttttggtagaaaaatcatgactaaattgaactacattttgtccattattgatgatacctacgatgcttacggtactttggaagaatgcacgatgttcagtgaagctgttgctcgttggaacattgaagctgttgacatgttgccagattatatgcgaattatctacagaactttgttggatacattcaacgaaatagaagaggatatggctaaacaacggagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 354 - protein, 565 aa, Actinidia deliciosa
  germacrene-D synthase
  ref <308>: DATABASE ACCESSION NUMBER: Genbank Acc. No. AAX16121.1
MQLPCAQALPIPTVTTTTSIEPPHVTRRSANYHPSIWGDHFLAYSSDAMEEEVINMEQQQRLHHLKQKVRKMLEAAAEQSSQMLNLVDKIQRLGVSYHFETEIETALRHIYKTCDYHFDDLHTAALSFRLLRQQGYPVSCDMFDKFKNSKGEFQESIISDVQGMLSLYEATCLRIHGEDILDEALAFTITQLRSALPNLSTPFKEQIIHALNQPIHKGLTRLNARSHILFFEQNDCHSKDLLNFAKLDFNLLQKLHQRELCEITRWWKDLNFAKTLPFARDRMVECYFWILGVYFEPQYLLARRMLTKVIAMISIIDDIYDVYGTLEELVLFTDAIERWEISALDQLPEYMKLCYQALLDVYSMIDEEMAKQGRSYCVDYAKSSMKILVRAYFEEAKWFHQGYVPTMEEYMQVALVTAGYKMLATSSFVGMGDLATKEAFDWVSNDPLIVQAASVIGRLKDDIVGHKFEQKRGHVASAVECYSKQHGTTEEEAIIELDKQVTHSWKDINAECLCPIKVPMPLLARVLNLARVLYVIYQDEDGYTHPGTKVENFVTSVLIDSMPIN

SEQ ID NO: 355 - protein, 868 aa, Abies grandis
  abietadiene cyclase
  ref <308>: DATABASE ACCESSION NUMBER: Gnebank Acc. No. AAB05407.1
MAMPSSSLSSQIPTAAHHLTANAQSIPHFSTTLNAGSSASKRRSLYLRWGKGSNKIIACVGEGGATSVPYQSAEKNDSLSSSTLVKREFPPGFWKDDLIDSLTSSHKVAASDEKRIETLISEIKNMFRCMGYGETNPSAYDTAWVARIPAVDGSDNPHFPETVEWILQNQLKDGSWGEGFYFLAYDRILATLACIITLTLWRTGETQVQKGIEFFRTQAGKMEDEADSHRPSGFEIVFPAMLKEAKILGLDLPYDLPFLKQIIEKREAKLKRIPTDVLYALPTTLLYSLEGLQEIVDWQKIMKLQSKDGSFLSSPASTAAVFMRTGNKKCLDFLNFVLKKFGNHVPCHYPLDLFERLWAVDTVERLGIDRHFKEEIKEALDYVYSHWDERGIGWARENPVPDIDDTAMGLRILRLHGYNVSSDVLKTFRDENGEFFCFLGQTQRGVTDMLNVNRCSHVSFPGETIMEEAKLCTERYLRNALENVDAFDKWAFKKNIRGEVEYALKYPWHKSMPRLEARSYIENYGPDDVWLGKTVYMMPYISNEKYLELAKLDFNKVQSIHQTELQDLRRWWKSSGFTDLNFTRERVTEIYFSPASFIFEPEFSKCREVYTKTSNFTVILDDLYDAHGSLDDLKLFTESVKRWDLSLVDQMPQQMKICFVGFYNTFNDIAKEGRERQGRDVLGYIQNVWKVQLEAYTKEAEWSEAKYVPSFNEYIENASVSIALGTVVLISALFTGEVLTDEVLSKIDRESRFLQLMGLTGRLVNDTKTYQAERGQGEVASAIQCYMKDHPKISEEEALQHVYSVMENALEELNREFVNNKIPDIYKRLVFETARIMQLFYMQGDGLTLSHDMEIKEHVKNCLFQPVA

SEQ ID NO: 356 - protein, 628 aa, Abies grandis
  pinene synthase
  ref <308>: DATABASE ACCESSION NUMBER: Genbank Acc. No. O24475
MALVSTAPLASKSCLHKSLISSTHELKALSRTIPALGMSRRGKSITPSISMSSTTVVTDDGVRRRMGDFHSNLWDDDVIQSLPTAYEEKSYLERAEKLIGEVKNMFNSMSLEDGELMSPLNDLIQRLWIVDSLERLGIHRHFKDEIKSALDYVYSYWGENGIGCGRESVVTDLNSTALGLRTLRLHGYPVSSDVFKAFKGQNGQFSCSENIQTDEEIRGVLNLFRASLIAFPGEKIMDEAEIFSTKYLKEALQKIPVSSLSREIGDVLEYGWHTYLPRLEARNYIQVFGQDTENTKSYVKSKKLLELAKLEFNIFQSLQKRELESLVRWWKESGFPEMTFCRHRHVEYYTLASCIAFEPQHSGFRLGFAKTCHLITVLDDMYDTFGTVDELELFTATMKRWDPSSIDCLPEYMKGVYIAVYDTVNEMAREAEEAQGRDTLTYAREAWEAYIDSYMQEARWIATGYLPSFDEYYENGKVSCGHRISALQPILTMDIPFPDHILKEVDFPSKLNDLACAILRLRGDTRCYKADRARGEEASSISCYMKDNPGVSEEDALDHINAMISDVIKGLNWELLKPDINVPISAKKHAFDIARAFHYGYKYRDGYSVANVETKSLVTRTLLESVPL

SEQ ID NO: 357 - protein, 581 aa, Abies grandis
  d-selinene synthase
  ref <308>: DATABASE ACCESSION NUMBER: Genbank Acc. No. AAC05727.1
MAEISESSIPRRTGNHHGNVWDDDLIHSLNSPYGAPAYYELLQKLIQEIKHLLLTEMEMDDGDHDLIKRLQIVDTLECLGIDRHFEHEIQTAALDYVYRWWNEKGIGEGSRDSFSKDLNATALGFRALRLHRYNVSSGVLKNFKDENGKFFCNFTGEEGRGDKQVRSMLSLLRASEISFPGEKVMEEAKAFTREYLNQVLAGHGDVTDVDQSLLREVKYALEFPWHCSVPRWEARSFLEIYGHNHSWLKSNINQKMLKLAKLDFNILQCKHHKEIQFITRWWRDSGISQLNFYRKRHVEYYSWVVMCIFEPEFSESRIAFAKTAILCTVLDDLYDTHATLHEIKIMTEGVRRWDLSLTDDLPDYIKIAFQFFFNTVNELIVEIVKRQGRDMTTIVKDCWKRYIESYLQEAEWIATGHIPTFNEYIKNGMASSGMCILNLNPLLLLDKLLPDNILEQIHSPSKILDLLELTGRIADDLKDFEDEKERGEMASSLQCYMKENPESTVENALNHIKGILNRSLEEFNWEFMKQDSVPMCCKKFTFNIGRGLQFIYKYRDGLYISDKEVKDQIFKILVHQVPMEE

SEQ ID NO: 358 - protein, 593 aa, Abies grandis
  gamma-humulene synthase
  ref <308>: DATABASE ACCESSION NUMBER: Genbank Acc. No. AAC05728
MAQISESVSPSTDLKSTESSITSNRHGNMWEDDRIQSLNSPYGAPAYQERSEKLIEEIKLLFLSDMDDSCNDSDRDLIKRLEIVDTVECLGIDRHFQPEIKLALDYVYRCWNERGIGEGSRDSLKKDLNATALGFRALRLHRYNVSSGVLENFRDDNGQFFCGSTVEEEGAEAYNKHVRCMLSLSRASNILFPGEKVMEEAKAFTTNYLKKVLAGREATHVDESLLGEVKYALEFPWHCSVQRWEARSFIEIFGQIDSELKSNLSKKMLELAKLDFNILQCTHQKELQIISRWFADSSIASLNFYRKCYVEFYFWMAAAISEPEFSGSRVAFTKIAILMTMLDDLYDTHGTLDQLKIFTEGVRRWDVSLVEGLPDFMKIAFEFWLKTSNELIAEAVKAQGQDMAAYIRKNAWERYLEAYLQDAEWIATGHVPTFDEYLNNGTPNTGMCVLNLIPLLLMGEHLPIDILEQIFLPSRFHHLIELASRLVDDARDFQAEKDHGDLSCIECYLKDHPESTVEDALNHVNGLLGNCLLEMNWKFLKKQDSVPLSCKKYSFHVLARSIQFMYNQGDGFSISNKVIKDQVQKVLIVPVPI

SEQ ID NO: 359 - protein, 816 aa, Abies grandis
  E-alpha-bisabolene synthase
  ref <308>: DATABASE ACCESSION NUMBER: Genbank Acc. No. AAK83562
AGVSAVSKVSSLVCDLSSTSGLIRRTANPHPNVWGYDLVHSLKSPYIDSSYRERAEVLVSEIKVMLNPAITGDGESMITPSAYDTAWVARVPAIDGSARPQFPQTVDWILKNQLKDGSWGIQSHFLLSDRLLATLSCVLVLLKWNVGDLQVEQGIEFIKSNLELVKDETDQDSLVTDFEIIFPSLLREAQSLRLGLPYDLPYIHLLQTKRQERLAKLSREEIYAVPSPLLYSLEGIQDIVEWERIMEVQSQDGSFLSSPASTACVFMHTGDAKCLEFLNSVMIKFGNFVPCLYPVDLLERLLIVDNIVRLGIYRHFEKEIKEALDYVYRHWNERGIGWGRLNPIADLETTALGFRLLRLHRYNVSPAIFDNFKDANGKFICSTGQFNKDVASMLNLYRASQLAFPGENILDEAKSFATKYLREALEKSETSSAWNNKQNLSQEIKYALKTSWHASVPRVEAKRYCQVYRPDYARIAKCVYKLPYVNNEKFLELGKLDFNIIQSIHQEEMKNVTSWFRDSGLPLFTFARERPLEFYFLVAAGTYEPQYAKCRFLFTKVACLQTVLDDMYDTYGTLDELKLFTEAVRRWDVSFTENLPDYMKLCYQIYYDIVHEVAWEAEKEQGRELVSFFRKGWEDYLLGYYEEAEWLAAEYVPSLDEYIKNGITSIGQRILLLSGVLIMDGQLLSQEALEKVDYPGRRVLTELNSLISRLADDTKTYKAEKARGELASSIECYMKDHPECTEEEALDHIYSILEPAVKELTREFLKPDDVPFACKKMLFEETGVTMVIFKDGDGFGVSKLEVKDHIKECLIEPLPL

SEQ ID NO: 360 - protein, 555 aa, Arabidopsis thaliana
  myrcene/ocimene synthase
  ref <308>: DATABASE ACCESSION NUMBER: Genbank Acc. No. AAG09310
PCNKSPTVQRRSANYQPSRWDHHHLLSVENKFAKDKRVRERDLLKEKVRKMLNDEQKTYLDQLEFIDDLQKLGVSYHFEAEIDNILTSSYKKDRTNIQESDLHATALEFRLFRQHGFNVSEDVFDVFMENCGKFDRDDIYGLISLYEASYLSTKLDKNLQIFIRPFATQQLRDFVDTHSNEDFGSCDMVEIVVQALDMPYYWQMRRLSTRWYIDVYGKRQNYKNLVVVEFAKIDFNIVQAIHQEELKNVSSWWMETGLGKQLYFARDRIVENYFWTIGQIQEPQYGYVRQTMTKINALLTTIDDIYDIYGTLEELQLFTVAFENWDINRLDELPEYMRLCFLVIYNEVNSIACEILRTKNINVIPFLKKSWTDVSKAYLVEAKWYKSGHKPNLEEYMQNARISISSPTIFVHFYCVFSDQLSIQVLETLSQHQQNVVRCSSSVFRLANDLVTSPDELARGDVCKSIQCYMSETGASEDKARSHVRQMINDLWDEMNYEKMAHSSSILHHDFMETVINLARMSQCMYQYGDGHGSPEKAKIVDRVMSLLFNPIPLD

SEQ ID NO: 361 - protein, 530 aa, Arabidopsis thaliana
  synthase
  ref <308>: DATABASE ACCESSION NUMBER: Genbank Acc. No. AAC64880
MQELINTLSALTTEEIYRPLADFPVNIWEDPLISFSVLDPESEINEEKLSSLKETVRGLLMASKEEPIENIKFIDALCRLGVSYHFEVDIFTQLETMFGVMMIRGNEFDLYTVSLVFQIFRQFGYKLGVDVFNNFKNKDGKFKEHLAEDARGLLCLYEAAHWSTHGEDILDEALAFSRSHLEGLADQSSPPMSIRIKNALKHAYPRGISRIETRQYISYYEEEDLHDQTLLEFAKIDFNLLQILHRKELCQVFRWYSNLELDLKVPYARNRTVESYLWAVGAYFEPRYSQARIRLAIVVILLTLVDDTGIEGLPESMRYLHHVVLDFYGKLEEDMEREGRSGCGLFAKKSMIVTAKAYLQEAKWLSEDFVATFDEYKENGVYSSSYLALLTGSFLGMVDEGTLDVFEWLSTFPPLLVTSALIGRLCGDIASCEFEHKRKHVGTSIDCYMKQYGISWEKAEEEIKIMALDSWKSLNQELMTRDHSFAFPIVMRFLNLSRVVKVLYKDTDIFTHPELMKHHVVSLFLNRISI

SEQ ID NO: 362 - protein, 632 aa, Arabidopsis thaliana
  synthase
  ref <308>: DATABASE ACCESSION NUMBER: Genbank Acc. No. AAB61105
MEAITKYGSYFNVRFLSRLCWRLNLSSSYHYPLLKSSLSFSRFQSPKKLCLVRATTNPTDDNSTTRSFTPHPPSLWGHHFLSASVNQTEMDDLWRQIEALKPIVNAMLLPCNGADAKKITCFIHTLVSLGVSYHFEEKIVEFLKDAFENIEDMIIDCKEDDLYTVSIIFRVFRLYGHYITPELHITISYYFFFLIFHTCMCVDIFNRFKGDDGNFKKCLNDDVRGMLSFYEASHFGTTTEDILEEAMSFTQKHLELFLVGEKAKHYPHITKLIQAALYIPQNFNLEILVAREYIDFYELETDHNEMLLKLAKLNFRFLQLQYIQDLKTLTTWWKELDLVSKIPVYFRERLAEPYFWATGIYYEPQYSAARIMLAKSIILVDIVDNTFDVYGTIDEVKSLVQAIERWDSDAVDVLPDYLKVVFRTTFDLFKELEEYVSSEARSFTMQYAYEQLRILMKGYLQEAEWSNRGHLPSHEEYIEVGVASTAGEVLLAMTFIPMGDAAGVGVYEWLRSRPKLTHALFVKSRLRDDIATYKEEMKRGDVCNGINCYTKQHKVSEEEACIEFEKKTNHMSKVMNEEFLKAAKFIPLHILRPVLNYGRLADVCYKYGDGYTFAGEKIKDYITSLYVDLITL

SEQ ID NO: 363 - protein, 599 aa, Arabidopsis thaliana
  terpene cyclase TC1
  ref <308>: DATABASE ACCESSION NUMBER: Genbank Acc. No. CAA72070
MYSISLVVNMQCISAYGSILSLPLRSNLFSVRKLSSFPHKSFSGQHGKLVRMKATPTRACHDQESNRKFKRLPLSKWGHHFLSAQVDVSEMNALAQEIERLKPEVGEMLMFSSKSIESTKKRILFIYMLVSLGVAFHFEDEIEQSLEEGFEKIQEMIAGEDDLYTISIMFWVFRTYGYNMSTGDVFKRFKGENEKFMESITSDVKGMVSLYEAAHLRTTREDILEEALSFTTRNLESLARAGASSPHILMRIRNALCMPQHYNAEMIFAREYISFYEQEEDHNKMLLRFAKINFKFLQLNWIQELKTLTKWWKQQDLASKLPPYFRDRLIECYLFAIMIYFEPQFSLGRVSLAKINTVFTLVDDTCDRYGNVSEVAALVQCVERWDPDCMDSLPDYMKTVFKFAWNTFEECENAGIMEEGLSYDVQGALEEWEQGDVVPTFDEYLEIGGVEVTMYVSIACSFLGLGQSSREQAYKWLKSRPKFVEAQAKRARLMNDIAGFEGDMSRGFDVNAIMYYMKQYKVTEEETFTRLQKMARDLDTTVNEEILKTTKSVPRQILKRAIDFGKMIEFTYRSGEEYTHPEGRFKDHITSLFVDLIRL

SEQ ID NO: 364 - protein, 603 aa, Arabidopsis thaliana
  terpene synthase/cyclase family protein
  ref <308>: DATABASE ACCESSION NUMBER: NCBI Acc. No. NP_174635
MEAARMGFRAKTLPHLGNGTRLPLKTKLSLFPMHLLQNHTTLSRRSTKLNLCVKACSKTSGVESSRPLPHSAPDLWGDHILSVPTENSEFDTLETEIESIKPKVRNMLMSSHKTDKERICLIHLLICLGTFHYFEKEIEEILEQAFRKLDMLFTDEDDLETTAIMFEVFRLYGHKISCDVFDRFKGVDAKFKEHLVSDVRGMLQLYEAAHLATPFETILDEALSFTRYHLESLAGQQATAPHISRHILNALYKPRFLKMEIIAAREYIHFYQKEGHDETLLKFAKLNFNFCQLHYVRELKTLTKWWKDIDLPYKLPYIRDRLLETFIGVMAVYLEPHYSLGRIIATKVSQVIVVMDDTCDAYGTFSEVRSLIDSLERWDPGAIDKLPSCLRIVIQSIVETMEDIEREMKPRGRSSSVQDTVEEIKIMGRAYAEISKWARAGHVPTFDDYIELGLDSSGIRCFAMYSFISMEDCEENQTNAWFKSKPKMLRALSVIFRLTNDIAGFEEEMRRGEVVNGVNCYVKQHNVTKELAVREIKKMIRDNYKIMMEEFLTIKSVSRPILVRCFNIVRLVNLYYEEGDNFTNPNGKLKDLITSLFFHPLPL

SEQ ID NO: 365 - protein, 603 aa, Arabidopsis thaliana
  terpene synthase/cyclase family protein
  ref <308>: DATABASE ACCESSION NUMBER: NCBI Acc. No. NP_175312
MEAIRVFGPKLGSRLSIRSHTTAFPACKLSRFPLTSFPGKHAHLVLLKATTIPLASGDKENNRKFEKLGPSEWGNQFLFAHVDLSEMDALEREIEALKPKVRDMFMSFKGMKSNKKNLFLIYLLVSLGLAHHFEDEIEESVKGCSQEMVEMMDGENDLYTVSIIFWVFRTYGHNISSDIFNRFKGHNGKFKECLATDAKGILSLYEAAHMGTTTDYILDEALSFTLSYLESLAANGTCKPNLVRRIRNALGLLQNKNVEILVAKEYIRFYEQEEDCDKTILEFSMLNLKFLQLHYLQELKLLTKWYKEQDFESKLPPYYRDRIVELHLATLAYINPKYSRVRIILTMIYTIQIILDDTCDRYASLREVESLAATIERWDHNDHAMEGLPDYLKSVAKFIFHTFQEFEREVSSESGGSYSLKATIEDCKRMMRSNLQLAKWAVTGHLPSFDEYLDVAGVEIAVYFTVAGILLGMENINKKEAYEWLIFRDKLVRAMSTKARLVNDLFGYKDDMRRGYVTNSINCYKKQYGVTEEEAFRKLHQMVADGDKMMNEEFLKPINVPHQVLKAVLDTLRAINICYDNEDGFTRLNGNLKNYITSMYVDL

SEQ ID NO: 366 - protein, 601 aa, Arabidopsis thaliana
  terpene synthase/cyclase family protein
  ref <308>: DATABASE ACCESSION NUMBER: NCBI Acc. No. NP_188067
MEATRTSFGLHNAPLCPTTNPSLFPRRWLHKHTLSLKPAKQHHLVCVRATESNDNLESSRPLAHFSPTLWGDHFLSVPLHVAEFDDFSREIEVTMKPKVRDMLKSSKNSDNERIRLIHLLMNLGIAYHFEIEIDEILGQAFGNLDDIIAKENDLETISTMFEVFRLRGYYMPCYAFNRFKGEDGRFKESLAEDIRGMLQLYEAAHLGTPSEDIMDEALSFTRYRLESLTSNHTATASPHLSKHIQNALYRARYHNLEILVAREYISFYEQEEDHDETLLKFAKLNFNYCQLHYIQELKDLTKWWKELDLASKLPYIRDRIVEVYFGALALYFEPRYSLGRIIVTKITMIVTVFNDTCDAYGTLPEVTSLVDSFQRWDLGDIEKLPSYVKIVFRGVFETLEEIEQEMRPQGRSRIVQVAVDEIKKLGKAYLAISKWARASHVPTFEEYMEFGMQTSMDHFAAYSFIAMEDCDENQTCEWYKSRPKMMEALNGVFRIKNDINTFEQEMSRGEVAKGLNCYMKQHGVSKEEAIGEMNKIYSNYYKIIMEEYLTTTAVPRPILVRCLNVSRPIHHFYKERDEFTDPYFGMLKEVITSLFIHPIPL

SEQ ID NO: 367 - protein, 604 aa, Arabidopsis thaliana
  terpene synthase/cyclase family protein
  ref <308>: DATABASE ACCESSION NUMBER: NCBI Acc. No. NP_189746
MAVARTVFGLGTLSYLHQAPLFLKTSQSLFPRPSLSLKPMKHDFVCVKATTKSSTSDDLESGRPSILFSPSIWGDYFLSVSVDDSEFDDIAREIESVMKPYVRDRLISSHNSNKDKIRLIHLLISLGISYYFESEIEMILNKAFEELDMIIAEEDDLETISIMFEVFRLYQHKMSCDSFVRFKGEDGRLKESLVGDVRGMLQLYQAAHLGTPSDQYIMEEAKSFTRNHLESLVESTTIPPHFSSHIRDALYIDRYHNMEILVARKYISFYEQEEGHDLTLLKFGKLSFNYCRLHYIQELKTLTKWWKDQDIPSNLPCVRDRIVETYFPTLGLYFEPRFSLGRIIIAKMTIIVVALNDVCDSYATYPEAKSLIDSLQRWDIEAIDELPNYSRIVLRLILETIGEIEREMKPRGRSASVQHTIDETKSLGRAYLALSKWASEGYMPTFDEYMEVGEVTGGMDDFALYSFIAMEDCDEKPLYEWFDSKPKILQALSVLYRINNDIVTYEREMSKGEVVNGVNSYMNQHGVTKEEAVEELRKMARDNYKIVMEELLTITDVPRPVLVRCLNLARLFDVFCKHGNDEFTYPHGNLKDLITSIFIHPIPV

SEQ ID NO: 368 - protein, 600 aa, Arabidopsis thaliana
  terpene synthase/cyclase family protein
  ref <308>: DATABASE ACCESSION NUMBER: NCBI Acc. No. NP_193754
MEAIKTFSPKFGFQISLSPRTHLTPVRFPPTACPVKPANLVRLKATRALIRDPQESNRKFQKFPPSEWTNRFDSVSVDASEMDALRKEIDKIIPNVKKELMSSQGIESTKKKILMVYLLVSLGLAYHFEDEIEECLKEGFETIEEMMAGEDNLYTISIIFLVLRTYGHHMSSDIFQKFKGNDGNFKGCISGDAKGLLALYEAAQLRTTTEYIMEEALSFTSSNLELLAADGRCPPHLSKHIRNALGLSQHKQMEVLVAVEYISFYEQEKDHDKILLKFAKLNFKLMQLHYLEELKVVTKWYKEHDFASNLPPYFKYVIVENHFFAITMYFEPKFSQKRIMLAKYFTVLVLLDDTCDRYASLSEAESLTNSLERWAPDDAMDKQPHYLKFVFKFIMGCFEEFERELASEGRSYSVKATLEEFKTIVKANFDFAKLAHTGHVPSFKEYMEVGEVEVGVCATLAGNLMCIGHIGDEGVYEWLKSRPKFLKAASTYGRLMNDIAGFEDDMKREYVITGVNTYMKQYGLTKMEAIRELQNLVEYNHTIMNEEFLKTTDLPRQIRKQVINVARSLNVSYTEGEGFTHTKGKVDEYITSLFITPIRI

SEQ ID NO: 369 - protein, 802 aa, Arabidopsis thaliana
  GA1 ent-copalyl diphospahte synthase
  ref <308>: DATABASE ACCESSION NUMBER: NCBI Acc. No. NP_192187
MSLQYHVLNSIPSTTFLSSTKTTISSSFLTISGSPLNVARDKSRSGSIHCSKLRTQEYINSQEVQHDLPLIHEWQQLQGEDAPQISVGSNSNAFKEAVKSVKTILRNLTDGEITISAYDTAWVALIDAGDKTPAFPSAVKWIAENQLSDGSWGDAYLFSYHDRLINTLACVVALRSWNLFPHQCNKGITFFRENIGKLEDENDEHMPIGFEVAFPSLLEIARGINIDVPYDSPVLKDIYAKKELKLTRIPKEIMHKIPTTLLHSLEGMRDLDWEKLLKLQSQDGSFLFSPSSTAFAFMQTRDSNCLEYLRNAVKRFNGGVPNVFPVDLFEHIWIVDRLQRLGISRYFEEEIKECLDYVHRYWTDNGICWARCSHVQDIDDTAMAFRLLRQHGYQVSADVFKNFEKEGEFFCFVGQSNQAVTGMFNLYRASQLAFPREEILKNAKEFSYNYLLEKREREELIDKWIIMKDLPGEIGFALEIPWYASLPRVETRFYIDQYGGENDVWIGKTLYRMPYVNNNGYLELAKQDYNNCQAQHQLEWDIFQKWYEENRLSEWGVRRSELLECYYLAAATIFESERSHERMVWAKSSVLVKAISSSFGESSDSRRSFSDQFHEYIANARRSDHHFNDRNMRLDRPGSVQASRLAGVLIGTLNQMSFDLFMSHGRDVNNLLYLSWGDWMEKWKLYGDEGEGELMVKMIILMKNNDLTNFFTHTHFVRLAEIINRICLPRQYLKARRNDEKEKTIKSMEKEMGKMVELALSESDTFRDVSITFLDVAKAFYYFALCGDHLQTHISKVLFQKV

SEQ ID NO: 370 - protein, 557 aa, Arabidopsis thaliana
  terpene synthase/cyclase family protein
  ref <308>: DATABASE ACCESSION NUMBER: NCBI Acc. No. NP_199276
MEALGNFDYESYTNFTKLPSSQWGDQFLKFSIADSDFDVLEREIEVLKPKVRENIFVSSSTDKDAMKKTILSIHFLDSLGLSYHFEKEIEESLKHAFEKIEDLIADENKLHTISTIFRVFRTYGYYMSSDVFKIFKGDDGKFKESLIEDVKGMLSFYEAVHFGTTTDHILDEALSFTLNHLESLATGRRASPPHISKLIQNALHIPQHRNIQALVAREYISFYEHEEDHDETLLKLAKLNFKFLQLHYFQELKTITMWWTKLDHTSNLPPNFRERTVETWFAALMMYFEPQFSLGRIMSAKLYLVITFLDDACDTYGSISEVESLADCLERWDPDYMENLQGHMKTAFKFVMYLFKEYEEILRSQGRSFVLEKMIEEFKIIARKNLELVKWARGGHVPSFDEYIESGGAEIGTYATIACSIMGLGEIGKKEAFEWLISRPKLVRILGAKTRLMDDIADFEEDMEKGYTANALNYYMNEHGVTKEEASRELEKMNGDMNKIVNEECLKITTMPRRILMQSVNYARSLDVLYTADDVYNHREGKLKEYMRLLLVDPILL

SEQ ID NO: 371 - protein, 605 aa, Arabidopsis thaliana
  terpene synthase
  ref <308>: DATABASE ACCESSION NUMBER: Genbank Acc. No. AAO85535
MEATSVFRPKLGSQFSLPSTTNLFPLRKLYGFPLTSFPGKPIKRIRLKASNTLTFDDKERTRKFKKLPLSEWTHYFHSIPLDISEMDALKEEIDELKPKVKNTFMSSQGSDSTKTKILMIYLFVSLGLAYHFEEEIYETLKEGFENIEKIMAGEEDLYTVSIIFWVFRRYGHYISSDVFQRFKGSNGSFKESLIGDAKGMLSLYEAAHLATTKDYILDEALIFTSSHLETLVATGTCPPHLLARIRNALSICQHWNFEVLVPLDFIPFYEQEKDHDEMLLKFAKLSFKYLKLIYLQDLKILTKWYKKLDFPSKFPPYFKDRCVENYFFVLPVFFEPQLSSARMLLTKGFILLGIQDDTFDRYASISEAESLGNSLKRWAPDHSMDKQPEYLKSVLKVILDTFQEFEKELSPEGRSYSVKYTIEEFQASSKANVELAKWAQVSHVPSFEKYMEVGQMEITACVTVAYILMSMGKTDSKEAFEWLKSRPKLVQSLCTKGRLMNDIAGFEDDMSRGYVVNAVNCYMKQYGVTEKEAFKEIRKMVVNTHKTLNEEFLTTTCVPHYVLRETMDFARMIIVTYNGYEGFTRPDEGIIKEYMTSLFVDQIDL

SEQ ID NO: 372 - protein, 603 aa, Arabidopsis thaliana
  terpene synthase
  ref <308>: DATABASE ACCESSION NUMBER: Genbank Acc. No. AAO85536
MEASKCFGPRTLPIIHNVPLCLKTNFSLFPRCLLQSQSLSSKKSTKHDLFRVKAETSGDLENTRPLTYYSPSLWGDHFLSVPIDESKFEALEKEIESVFKPKVRDMLMSPHSSDKERIRLIHLLISLGIAYYYENEIEEILHKAYGKLACLISDEDDLETIAIMFEVFRLYGHKMPCDVFERFKSEDGKFKESLVGDVRGLLQMYEAAHLGAPSEDIMDEALSFARYHLESLVSHETSSNLFNHVQNELYRARYHSIEILVARQYISFYEQEEDHDETLLRFSKLNFNFCQMHYVKDLKIVTRWWKELGIASKLPYSIRERNVEVYLGSLGMFFEPRYSLARIFSAKLTMILTVVDDTCDSYATLPEVKSLHDAFHRWDLRAMEELPRYMRIIYQSVFETVEDIDREMIARGKHGRLQLTIDEIKSLMIWYLGIAKWARSDQVPSFEDYMEIGTPSSALDDLASYGFIAMDDCDQKKLKEWFYSKPKIFHALNALFRIRNDIVTFEQEMSRGEVANGVNCYMKQHGVTKEAAVEELRKMERENYKIMIEEFMTSKAMPRQILVRPVNIARVMDLYYKEADGFGHPDQKLLQLIASLFLHPIPL

SEQ ID NO: 373 - protein, 605 aa, Arabidopsis thaliana
  terpene synthase
  ref <308>: DATABASE ACCESSION NUMBER: Genbank Acc. No. AAO85537
MDATRTFFGLPNVHNVPLCLTSNLSLFPQRLLQKHTLPLKPVKRHHLVCVRSTKSSDDLEGSRPSTYFSPSLWGDHFLSVSLDRGEFDELEREIETMKPLVKDMLMSSQSSDKEKIRLIHLLVSLGSSYHFDKEIQDILKHSFTKLDDIIVGEDDLETISIMFEVFRLYGHKMSCDAFDRFRGEDGRFKESLAKDVRGMLQLFEVAHLGTPSEDIMDEASSFAQNHLESWIAGNVSGATPHLLKHIQNSLYIPRYCNIEVLVAREYISYYEQEEGYDEILLKFAKLNFNLCQFRYIQELKTLTKWWKDLDLASKLPYIRDRLVESHLGGLGPYFEPHYSLGRIIVAKIIMTMVVVDDTYDAHATVPEVAVLTECLQRLNIGADDKLPDYLRIVLESVFEVMGEIEQEMRPKGRSYGVKQVLERFKNVAKADKQLTEWARTGHVPSFDEYMKVGLVTAGMDGYAGYCFIGMEDISEKEAFEWLSSNPLIIQALNVMFRLANDVGTYETEINRGEVANGLNCYMKQYGVTKEEASQELRKIYSNNKKVVMEEFMNSHDHVPRQVLLRCLNFARLFDVMYTEGDGYSEPKGKIEHFMTSLYVHPIPLS

SEQ ID NO: 374 - protein, 547 aa, Arabidopsis thaliana
  beta-caryophyllene/alpha-humulene synthase
  ref <308>: DATABASE ACCESSION NUMBER: Genbank Acc. No. AAO85539
MGSEVNRPLADFPANIWEDPLTSFSKSDLGTETFKEKHSTLKEAVKEAFMSSKANPIENIKFIDALCRLGVSCHFEKDIVEQLDKSFDCLDFPQMVRQEGCDLYTVGIIFQVFRQFGFKLSADVFEKFKDENGKFKGHLVTDAYGMLSLYEAAQWGTHGEDIIDEALAFSRSHLEEISSRSSPHLAIRIKNALKHPYHKGISRIETRQYISYYEEEESCDPTLLEFAKIDFNLLQILHREELACVTRWHHEMEFKSKVTYTRHRITEAYLWSLGTYFEPQYSQARVITTMALILFTALDDMYDAYGTMEELELFTDAMDEWLPVVPDEIPIPDSMKFIYNVTVEFYDKLDEELEKEGRSGCGFHLKKSLQKTANGYMQEAKWLKKDYIATFDEYKENAILSSGYYGLIAMTFVRMTDVAKLDAFEWLNSHPKIRVASEIISRFTDDISSYEFEHKREHVATGIDCYMQQFGVSKERAVEVMGNIVSDAWKDLNQELMRPHVFPFPLLMRVLNLSRVIDVFYRYQDAYTNPKLLKEHIVSLLIETIPI

SEQ ID NO: 375 - protein, 565 aa, Arabidopsis thaliana
  (E)-beta-ocimene synthase/ myrcene synthase
  ref <308>: DATABASE ACCESSION NUMBER: NCBI Acc. No. NP_567511
MPKRQAQRRFTRKTDSKTPSQPLVSRRSANYQPSLWQHEYLLSLGNTYVKEDNVERVTLLKQEVSKMLNETEGLLEQLELIDTLQRLGVSYHFEQEIKKTLTNVHVKNVRAHKNRIDRNRWGDLYATALEFRLLRQHGFSIAQDVFDGNIGVDLDDKDIKGILSLYEASYLSTRIDTKLKESIYYTTKRLRKFVEVNKNETKSYTLRRMVIHALEMPYHRRVGRLEARWYIEVYGERHDMNPILLELAKLDFNFVQAIHQDELKSLSSWWSKTGLTKHLDFVRDRITEGYFSSVGVMYEPEFAYHRQMLTKVFMLITTIDDIYDIYGTLEELQLFTTIVEKWDVNRLEELPNYMKLCFLCLVNEINQIGYFVLRDKGFNVIPYLKESWADMCTTFLKEAKWYKSGYKPNFEEYMQNGWISSSVPTILLHLFCLLSDQTLDILGSYNHSVVRSSATILRLANDLATSSEELARGDTMKSVQCHMHETGASEAESRAYIQGIIGVAWDDLNMEKKSCRLHQGFLEAAANLGRVAQCVYQYGDGHGCPDKAKTVNHVRSLLVHPLPLN

SEQ ID NO: 376 - protein, 547 aa, Artemisia annua
  putative sesquiterpene cyclase
  ref <308>: DATABASE ACCESSION NUMBER: Genbank Acc. No. CAB56499
MSLIVEDVIRPNANFPSEIWGDQFLAYDQDEQEGVEQVIKDLKEEVKSELLTALNSPTQHTELLKFIDAIERLGIAYYFEEEINQVFQHMYTAYGDKWTGGNTSLWFRLMRQHGFFVSSDIFSTYKDKEGRFKESLEKDVHGLLELYEAAYMFVPGEGILDDALVFTRTCLDEIAKNPSLSNSAISSQIREALTQPLHKRLPRLEALRYIPFYQQQASHSETLLKLAKLGFNQLQSLHKKELSIISKWWKSFDVANNLPYARNRPVECYFWALAVYFEPQYSESRVFLSRFFSIQTFLDDTYDAYGTYEELEQFTEAIQRWSITCLDGLPESMKLIFQMLVKIFEEIEEILSKDGKQHHVNYIKETLKEAVQSYMTEARWAKEEYIPTIEEHTKVSYISIGYKLALVAGFACMGDVIADDSFEWVFTNPPLVNACCLLCRTMDDLGSHKGEQDRKHVASTIECYMKQFDASEQQAYESLNKKVEDAWKEINREFMITCKDVNIHVAMRVLNFSRSVDVLYKNKDHFTHVGVEVINHIKSLFVDAIIT

SEQ ID NO: 377 - protein, 577 aa, Artemisia annua
  putative sesquiterpene cyclase
  ref <308>: DATABASE ACCESSION NUMBER: Genbank Acc. No. CAC12731
MSTLPISSVSFSSSTSPLVVDDKVSTKPDVIRHTMNFNASIWGDQFLTYDEPEDLVMKKQLVEELKEEVKKELITIKGSNEPMQHVKLIELIDAVQRLGIAYHFEEEIEEALQHIHVTYGEQWVDKENLQSISLWFRLLRQQGFNVSSGVFKDFMDEKGKFKESLCNDAQGILALYEAAFMRVEDETILDNALEFTKVHLDIIAKDPSCDSSLRTQIHQALKQPLRRRLARIEALHYMPIYQQETSHNEDLLKLAKLDFSVLQSMHKKELSHICKWWKDLDLQNKLPYVRDRVVEGYFWILSIYYEPQHARTRMFLMKTCMWLVVLDDTFDNYGTYEELEIFTQAVERWSISCLDMLPEYMKLIYQELVNLHVEMEESLGKGGKNISNSLCQGRWQKELGSQITLVETKMAKRGVHAQPLEEYMSVSMVTGTYGLMIARSYVGRGDIVTEDTFKWVSSYPPIIKASCVIVRLMDDIVSHKEEQERGHVASSIECYSKESGASEEEACEYISRKVEDAWKVINRESLRPTAVPFPLLMPAINLARMCEVLYSVNDGFTHAEGDMKSYMKSFFVHPMVV

SEQ ID NO: 378 - protein, 549 aa, Artemisia annua
  putative sesquiterpene cyclase
  ref <308>: DATABASE ACCESSION NUMBER: Genbank Acc. No. CAC12732
MSVKEEKVIRPIVHFPPSVWADQFLIFDDKQAEQANVEQVVNELREDVRKDLVSSLDVQTEHTNLLKLIDAIQRLGIAYHFEEEIEQALQHIYDTYGDDWKGRSPSLWFRILRQQGFYVSCDIFKNYKKEDGSILRNPLTNDVEGLLELYEATYLRVQGEGVLDDALVFTRTCLEKIAKDLVHTNPTLSTYIQEALKQPLQKRLARLEALHYIPMYEQQASHNESLLKLAKLGFNLLQSLHRKELNEVSRWWKGLDVPNNLPYARDRMVECYFWALGVYFEPKYSQARIFLAKVISLATVLDDTYDAYGTYEELKIFTEAIQRWSITCIDMLPEYLKLLYQGVLDIYIEMEEIMGKEGKAHHLSYAKESMKEFIRSYMMEAKWANEGYVPTAEEHMSVAFVSSGYSMLATTCFVGMGDIVTDEAFKWALTKPPIIKASCAIARLMDDIHSQKEEKERIHVASSVESYMKQYDVTEEHVLKVFNKKIEDAWKDITRESLVRKDIPMPLMMRVINLAQVMDVLYKHKDGFTNVGEELKDHIKSLLVHPIPI

SEQ ID NO: 379 - protein, 582 aa, Artemisia annua
  (-)-beta-pinene synthase
  ref <308>: DATABASE ACCESSION NUMBER: Genbank Acc. No. AAK58723
MASMCTFSSPFLLCNSSISRTNIVACNKQTSTLQAQVKNVATIETTNRRSANYAPSLWSYDFVQSLSSKYKGDNYMARSRALKGVVRTMILEANGIENPLSLLNLVDDLQRLGISYHFLDEISNVLEKIYLNFYKSPEKWTNMDLNLRSLGFRLLRQHGYHIPQEIFKDFIDVNGNFKGDIISMLNLYEASYHSVEEESILDDAREFTTKYLKETLENIEDQNIALFISHALVFPLHWMVPRVETSWFIEVYPKKVGMNPTVLEFAKLDFNILQAVHQEDMKKASRWWKETCWEKFGFARDRLVENFMWTVAENYLPHFQTGRGVLTKVNAMITTIDDVYDVYGTLPELELFTNIVNSWDINAIDELPDYLKICFLACYNATNELSYNTLTNKGFFVHPYLKKAWQDLCNSYIIEAKWFNDGYTPTFNEFIENAYMSIGIAPIIRHAYLLTLTSVTEEALQHIERAESMIRNACLIVRLTNDMGTSSDELERGDIPKSIQCYMHESGATEMEARAYIKQFIVETWKKLNKERQEIGSEFPQEFVDCVINLPRMGHFMYTDGDKHGKPDMFKPYVFSLFVNPI

SEQ ID NO: 380 - protein, 573 aa, Artemisia annua
  sesquiterpene cyclase
  ref <308>: DATABASE ACCESSION NUMBER: Genbank Acc. No. AAG24640
MSTFLVCNASFSPSYGLPSSCDRNSSMNQEIVRNTVKFPPSIWGDQFLTYHEPKKSLTIEKQHVEEVEEIRKKLLNTAFSEPKQHTKLIHLIDSVQRLGVSYHFEQEIEEALQHVYATHGDQWIGKDNLKSTSQWFRILRQQGFNVSSGIFENHMDDKGKFKEHLSDDVQGMLGLYEAAYMSVEGEKELDDALEFTKTHLGNIAKDPSQNASLRTKIEQALNRPLRKRMPRLEALHYIPKYQQEASHDETLLNLAKLDYNMLQSIHKREISEICKWWKDLDFSNKLPHVRDRLVEIYFWVLGVYFEPQHYRSRMFLTKTSMWLIVLDDTYDNYGTYEELKIFTEAVQRWSLSCLDSLPEYMKLIYRELINHYQEMEESVEKEGKSYQLFYAKEMVKENCRNLLVEAKWLKEGYVPTLEEHMSVSCVTYAYAVMIANSYVGRENMVTEESFKWVAKFPPLVNATCLILRLMDDIAGHEEEQERDHVVSSIECYRNETGASEEDAVKFLSKQVEDAWKVINKECLRPTEIPMSLTIPPLSLARVSDILYKTNNGYNHAGEEVISYIKSLLVHPLV

SEQ ID NO: 381 - protein, 546 aa, Artemisia annua
  amorpha-4,11-diene synthase
  ref <308>: DATABASE ACCESSION NUMBER: Genbank Acc. No. AAK15696
MSLTEEKPIRPIANFPPSIWGDQFLIYEKQVEQGVEQIVNDLKKEVRQLLKEALDIPMKHANLLKLIDEIQRLGIPYHFEQEIDHALQCIYETYGDNWDGDRSSLWFRLMRKQGYYVTCDVFNNYKDKDGAFKQSLANDVEGLLELYEATSMRVPGEIMLEDALGFTRSRLSIMTKDAFSTNPALFTEIQRALKQPLWKRLPRIEAAQYIPFYQQQDSHNKTLLKLAKLEFNLLQSLHKEELSHVCKWWKAFDIKKNAPCLRDRIVECYFWGLGSGFEPQYSRARVFFTKAVAVITLIDDTYDAYGTYEELKIFTEAVERWSITCLDTLPEYMKPIYKLFMDTYTEMEEFLAKEGRTDLFNCGKEFVKEFVRNLMVEAKWANEGHIPTTEEHDPVVIITGGANLLTTTCYLGMSDIFTKESVEWAVSAPPLFRYSGILGRRLNDLMTHKAEQERKHSSSSLESYMKEYNVNEEYAQTLIYKEVEDVWKDINREYLTTKNIPRPLLMAVIYLCQFLEVQYAGKDNFTRMGDEYKHLIKSLLVYPMSI

SEQ ID NO: 382 - protein, 567 aa, Artemisia annua
  (3R)-linalool synthase
  ref <308>: DATABASE ACCESSION NUMBER: Genbank Acc. No. AAF13357
GNAYMRIYSTKTTRITANATVNAADTHVRRSANYKPSSWSFDHIQSLSSKYTGDDYVARANTLKDAVKTMIRKSGNSLRTLELVDELQRLGISYLFEEEISNLLETIYYNYYKFPENWNKINLNLKALGFRLLRQHGYHVPQEIFLNFKDKNQNLNSYLLNDVVEMLNLYEASYHSFEDESILDDARDITTKYLKESLEKIDGSIFSSVTHALEQPLHWRVPRVEAKWFIELYEKKNGMSPTLVELAKLDFDMVQAIHLEDLKHASRWWRDTSWDTKLTFARDLIVENFLWTIGFSYLPNFSRGRRTITKVAVMITTLDDVYDVFGTLGELEQFTDVINRWDIKAIEQLPDYMKICFLGLYKSINDITHETLANKGFLILPYLKKAWADLCKAYLVEAQWYHRGHIPTLNEYLDNACVSISGPVALMHVHFLTSVSSIEEIHQCIQRTENIVHYVSLIFRLADDLGTSLGEMERGDTLKSIQLHMHETGATEPEARSYIKLLINKTWKKLNKERATVNSESSQEFIDYATNLVRMAQFMYGEGDEDFGLDVIKSHVLSLLFTPIQGI

SEQ ID NO: 383 - protein, 562 aa, Artemisia annua
  germacrene A synthase
  ref <308>: DATABASE ACCESSION NUMBER: Genbank Acc. No. ABE03980
MAAVQANVTGIKANTKTSAEPVRPLANFPPSVWGDRFLSFSLDRSELERYAIAMEKPKEDLRKLIVDPTMDSNEKLGLIYSVHRLGLTYMFLQEIESQLDKLFNKFSLQDYEEVDLYTISINFQVFRHVGYKLPCDVFNKFKDVSSGTFKASITSDVGVVGLYESAQLRIRGEKILDEASVFTEAKLKSVVNTLEGDLAQQVTQSLRRPFHQGMPLGIRQGSISLTMKKNVPLMTHCLKLAKLHFKYLELQQKEELRIVSKWWKDMRFHETTPYIRDRVPEIYLWILGLYFEPRYSLARIIATKITLFLVVLDDTYDAYATIEEIRLLTDAINKWDISAMEQIPEYIRPFYKILLDEYAGNWRRKWLKKGEQILLLLQKKRSKTLARGYLEEAEWTNSGYVASFPEYMKNGLITSAYNVISKSALVGMGEIVSEDALAWYESHPKTLQASELISRLQDDVMTYQFERERGQSATGVDAYIKTYGVSEKEAIDALKIMIENAWKDINEGCLKPRQVSMDLLAPILNLARMIDVVYRYDDGFTFPRKDSERVYQSFCLWVLYPV

SEQ ID NO: 384 - protein, 559 aa, Capsicum annuum
  sesquiterpene cyclase
  ref <308>: DATABASE ACCESSION NUMBER: Genbank Acc. No. AAC61260
MASVAVENNVVNHIAEEIIRPVADFSPSLWGDRFLSFSIDNQVETKYAQEIEPLKEQTRSMLLASGRKLSETLNLIDVIERLGIAYHFEKEIDEILDRIYNENSNFEGDVYNEDLCTCRLQFRLLRQHGYNISLKIFSKFLDGNGRLKESLASDVLGLLSLYEASHVRSHGEDILEDALAFSTTHLESATPHLEYPLKEQVRHALEQSLHKGIPRIEIQFFISSVYDKQAIKNDVLLRFAKLDYNMLQMLHKQELAEVSRWWKDLNFVNTLPYARDRVVECYFWALGVYYEPQYSQARVMLVKTIAMISIVDDTYDAYGTVDELAIYTDVIQRWDIKEIDSLPDYMKISYKALLDLYKDYEKEMSRDGRSHVVYYAKERLKELVKSYNIEAKWFIEGHMPPASEYLRNAFVTTTYYYLATTSYLGMKYAKEQQFEWLSKNPKILEGCVTICRVIDDIATYEVEKNRGQLSTGIECYMRDYSVSTKEAMAKFQEMGESGWKDINEGMLRPTPIPMEFLSRILNLARLVDVTYKHNEDGYTHPEKVIKPHIIAMVVDSFKI

SEQ ID NO: 385 - protein, 559 aa, Capsicum annuum
  5-epi-aristolochene synthase
  ref <308>: DATABASE ACCESSION NUMBER: Genbank Acc. No. CAA06614
MASVAVENNVVNHIAEEIIRPVADYSPSIWGDRFLSFSIDNQVEQKYAQEIEPPKEQTRSMLLASPRKLSDTLNLIDVIERLAIAYHFEKEIDEILDRIYNENSNFEGDVYNEDLCTCALQFRLLRQHGYNISLEIFSKFLDGNGRLKESLASDVLGLLSLYEASHVRSHGEDILEDALAFSTTHLESATPHLEYPLKEQVRHALEQSLHKGIPRIEIQFFISSIYDKQAIKNDVLLRFAKLDYNMLQMLHKQELAEVSRWWKDLNFVNTLPYARDRVVECYFWALGVYYEPQYSQARVMLVKTIAMISIVDDTYEAYGTVDELAIYTDVIQRWDIKRIDSLPDYMKISYKALLDLYKDYEKEMSRDGRSHVVYYAKERLKELVKSYNIEAKWFIEGHMPPASEYLRNAFVTTTYYYLATTSYLGMKYAKEQQFEWLSKNPKILEGCVTICRVIDDIATYEVEKNRGQLSTGIECYMRDYSVSTKEAMAKFQEMGESGWKDINEGMLRPTPIPMEFLSRILNLARLVDVTYKHNEDGYTHPEKVIKPHIIAMVVDSFKI

SEQ ID NO: 386 - protein, 558 aa, Cichorium intybus
  germacrene A synthase short form
  ref <308>: DATABASE ACCESSION NUMBER: Genbank Acc. No. AAM21659
MAAVEANGTFQANTKTTEPVRPLANFPPSVWGDRFLSFSLDTTELEGYAKAMEEPKEEVRKLIVDPTMDSNKKLSLIYSVHRLGLTYLFLQEIEAQLDKLFKEFNLQDYDEFDLYTTSINFQVFRHLGHKLPCDVFNKFKDSSSGTFKESITNDVKGMLGLYESAQLRLRGEPILDEASAFTETQLKSVVNTLEGNLAKQVMQSLRRPFHQGMPMVEARMYFSNYDEECSTHESLPKLAKLHFNYLQLQQKEELRIVSKWWKDMRFQETTPYIRDRVPEIYLWILGLYFEPRYSLARIIATKITLFLVVLDDTYDAYATIEEIRLLTDAINRWDISAMEQIPEYIRPFYKILLDEYAELEKQLAKEGRAKSVIASKEAFQDIARGYLEEAEWTNSGYVASFPEYMKNGLITSAYNVISKSALVGMGEMVGEDALAWYESHPKTLQASELISRLQDDVMTYQFERERGQSATGVDSYIKTYGVTEKEAIDELNKMIENAWKDINEGCLKPREVSMDLLAPILNLARMIDVVYRYDDGFTFPGKTMKEYITLLFVGSSPM

SEQ ID NO: 387 - protein, 583 aa, Cichorium intybus
  germacrene A synthase long form
  ref <308>: DATABASE ACCESSION NUMBER: Genbank Acc. No. AAM21658
MALVRNNSSNGREPVLSPRSLTSPRGLTSPRPLSVQPTPEPVRPLANFPPSIWADRFISFSLDNSQLEAYANALEEPKEAVKSLITDTTIDANTKLKLIYSVHRLGLSYLYPDEIDAELNKLFEKIDLQYYEQVDLYTIAVQFQVFRHHGYKISSDVFKKFKDSTTGTFTDDVTKDVKGMLSLYESAHLRLHGEDILDEALAFTEAHLKKILTTLEGDLARQVNQVLKRPFHTGMPMVEARLYFITHEEDFSSHESVVKLAKVHFNYLQLQQKEELRLVSQWWKDMQFQQSVPYIRDRVPEIYLWILGLYFEPYYSRARIIATKITLFLVVLDDTYDAYATIDEIRSITDAINRWEISAIDQLPEYIKPFYRILLNEYDDLEKEYSKDGRAFSVHASKQAFQEIARGYLEEAEWLHNGYVATFPEYMKNGLITSAYNVISKSALVGMGAIADEEALAWYETHPKILKASELISRLQDDVMTFQFERKRGQSATGVDAYIKEYNVSEEVAIKELMKMIENAWKDINEGCLKPTEVSVALLTPILNLARMIDVVYKFDDGFTFPGKTLKDYITLLFVSPPPSLEN

SEQ ID NO: 388 - protein, 603 aa, Cinnamomum tenuipile
  geraniol synthase
  ref <308>: DATABASE ACCESSION NUMBER: Genbank Acc. No. CAD29734
MALQMIAPFLSSFLPNPRHSLAAHGLTHQKCVSKHISCSTTTPTYSTTVPRRSGNYKPSIWDYDFVQSLGSGYKVEAHGTRVKKLKEVVKHLLKETDSSLAQIELIDKLRRLGLRWLFKNEIKQVLYTISSDNTSIEMRKDLHAVSTRFRLLRQHGYKVSTDVFNDFKDEKGCFKPSLSMDIKGMLSLYEASHLAFQGETVLDEARAFVSTHLMDIKENIDPILHKKVEHALDMPLHWRLEKLEARWYMDIYMREEGMNSSLLELAMLHFNIVQTTFQTNLKSLSRWWKDLGLGEQLSFTRDRLVECFFWAAAMTPEPQFGRCQEVVAKVAQLIIIIDDIYDVYGTVDELELFTNAIDRWDLEAMEQLPEYMKTCFLALYNSINEIGYDILKEEGRNVIPYLRNTWTELCKAFLVEAKWYSSGYTPTLEEYLQTSWISIGSLPMQTYVFALLGKNLAPESSDFAEKISDILRLGGMMIRLPDDLGTSTDELKRGDVPKSIQCYMHEAGVTEDVARDHIMGLFQETWKKLNEYLVESSLPHAFIDHAMNLGRVSYCTYKHGDGFSDGFGDPGSQEKKMFMSLFAEPLQVDEAKGISFYVDGGSA

SEQ ID NO: 389 - protein, 572 aa, Cistus creticus
  germacrene B synthase
  ref <308>: DATABASE ACCESSION NUMBER: Genbank Acc. No. ACF94469
MFTQTSLSSSAPALSTQNAKPEIVRRSAGFHPSIWGDQFLSYASNPVVENEEEKREHDLLKGKLKEKLMTAAENKSLIEDKETLDLIDLIQRLCVSYHFEKEISRILEQIMQLVTHNDHDHNHDDGDLYTTSLRFRLLRQNGYRIPCGVFNKFKDSEGNFKESLICDVKGMLSLYEAAHLRIQGEDILDEALSFTSTQLGAAKTTITTTNPSLAAQVAHALKQPIRKGLPRLQARRFMPVYEADPCHDKTLLTFAKLDFNMLQRLHQKEVGEITKWWKDIDFSNKMPFARDRVVECYFWTLGVYFEPKYTLGRKIFNKVIAMTSVLDDIYDVYGTLDELEIFTEAILRWDINTISQLPSYMQIYYQAFIDVYSEMEAQMEVEDKLYCVPYAKEVMKKLVRAYHQESKWFHANYVPPMEEYMSVALVSSGYEVLAATSFVGMGDVVTKDSFEWLFNYPKIITASLIMGRLMNDIVGHKFEQKRGHVASAVECYVKQYGGTEEEAVEEFRKQITNAWKDINEECLCPTAVPMPLLTRVLNLARVLEVIYNIDDCYTNSKLIVKDIASLLINPVP

SEQ ID NO: 390 - protein, 560 aa, Citrus junos
  (E)-beta-farnesene synthase
  ref <308>: DATABASE ACCESSION NUMBER: Genbank Acc. No. AAK54279
MKDMSIPLLAAVSSSTEETVRPIADFHPTLWGNHFLKSAADVETIDAATQEQHAALKQEVRRMITTTANKLAQKLHMIDAVQRLGVAYHFEKEIEDELGKVSHDLDSDDLYVVSLRFRLFRQQGVKISCDVFDKFKDDEGKFKESLINDIRGMLSLYEAAYLAIRGEDILDEAIVFTTTHLKSVISISDHSHANSNLAEQIRHSLQIPLRKAAARLEARYFLDIYSRDDLHDETLLKFAKLDFNILQAAHQKEASIMTRWWNDLGFPKKVPYARDRIIETYIWMLLGVSYEPNLAFGRIFASKVVCMITTIDDTFDAYGTFEELTLFTEAVTRWDIGLIDTLPEYMKFIVKALLDIYREAEEELAKEGRSYGIPYAKQMMQELIILYFTEAKWLYKGYVPTFDEYKSVALRSIGLRTLAVASFVDLGDFIATKDNFECILKNAKSLKATETIGRLMDDIAGYKFEQKRGHNPSAVECYKNQHGVSEEEAVKELLLEVANSWKDINEELLNPTTVPLPMLQRLLYFARSGHFIYDDGHDRYTHSLMMKRQVALLLTEPLAI

SEQ ID NO: 391 - protein, 555 aa, Citrus junos
  terpene synthase
  ref <308>: DATABASE ACCESSION NUMBER: Genbank Acc. No. AAG01339
MSAQVLATVSSSTEKTVRPIAGFHPNLWGDYFLTLASDCKTDDTTHQEEYEALKQEVRSMITATADTPAQKLQLVDAVQRLGVAYHFEQEIEDAMEKIYHDDFDNNDDVDLYTVSLRFRLLRQQGFKVPCDVFAKFKDDEGKFKASLVRDVHGILSLYEAGHLAIRGEGILDEAIAFTRTHLQSMVSQDVCPNNLAEQINHTLDCPLRRALPRVETRFFLSVYPRDDKHDKTLLKFSKLDFNLVQRIHQKELSAITRWWKDLDFTTKLPYARDRIVELYFWIVGTYFEPKYTLARKIMTKTIYTASIIDDTFDAYGFFEELKLFAEAVQRWDIGAMDILPEYMKVLYKALLDTFNEIEQDLAKEGRSSCLPYGKEKMQELVQMYFVQAKWFSEGYVPTWDEYYPVGLVSCGYFMLATNSFLGMCDVANKESFEWISRTLRFQQRHQFICRLRNDIVSHQFEQKRGHIASGVECYIKQYGVSAEEVVTVFTEEVENAWKDMNEEFLKPTAFPVALIERPFNIARVIEFLNKKGDWYTHSHAIKDQIAAVLRDPVTI

SEQ ID NO: 392 - protein, 600 aa, Citrus limon
  gamma-terpinene synthase
  ref <308>: DATABASE ACCESSION NUMBER: Genbank Acc. No. AAM53943
MALNLLSSLPAACNFTRLSLPLSSKVNGFVPPITQVQYPMAASTSSIKPVDQTIIRRSADYGPTIWSFDYIQSLDSKYKGESYARQLEKLKEQVSAMLQQDNKVVDLDPLHQLELIDNLHRLGVSYHFEDEIKRTLDRIHNKNTNKSLYARALKFRILRQYGYKTPVKETFSRFMDEKGSFKLSSHSDECKGMLALYEAAYLLVEEESSIFRDAIRFTTAYLKEWVAKHDIDKNDNEYLCTLVKHALELPLHWRMRRLEARWFIDVYESGPDMNPILLELAKVDYNIVQAVHQEDLKYVSRWWKKTGLGEKLNFARDRVVENFFWTVGDIFEPQFGYCRRMSAMVNCLLTSIDDVYDVYGTLDELELFTDAVERWDATTTEQLPYYMKLCFHALYNSVNEMGFIALRDQEVGMIIPYLKKAWADQCKSYLVEAKWYNSGYIPTLQEYMENAWISVTAPVMLLHAYAFTANPITKEALEFLQDSPDIIRISSMIVRLEDDLGTSSDELKRGDVPKSIQCYMHETGVSEDEAREHIRDLIAETWMKMNSARFGNPPYLPDVFIGIAMNLVRMSQCMYLYGDGHGVQENTKDRVLSLFIDPIP

SEQ ID NO: 393 - protein, 606 aa, Citrus limon
  (+)-limonene synthase 1 synthase
  ref <308>: DATABASE ACCESSION NUMBER: Genbank Acc. No. AAM53944
MSSCINPSTLVTSVNAFKCLPLATNKAAIRIMAKYKPVQCLISAKYDNLTVDRRSANYQPSIWDHDFLQSLNSNYTDEAYKRRAEELRGKVKIAIKDVIEPLDQLELIDNLQRLGLAHRFETEIRNILNNIYNNNKDYNWRKENLYATSLEFRLLRQHGYPVSQEVFNGFKDDQGGFICDDFKGILSLHEASYYSLEGESIMEEAWQFTSKHLKEVMISKNMEEDVFVAEQAKRALELPLHWKVPMLEARWFIHIYERREDKNHLLLELAKMEFNTLQAIYQEELKEISGWWKDTGLGEKLSFARNRLVASFLWSMGIAFEPQFAYCRRVLTISIALITVIDDIYDVYGTLDELEIFTDAVERWDINYALKHLPGYMKMCFLALYNFVNEFAYYVLKQQDFDLLLSIKNAWLGLIQAYLVEAKWYHSKYTPKLEEYLENGLVSITGPLIITISYLSGTNPIIKKELEFLESNPDIVHWSSKIFRLQDDLGTSSDEIQRGDVPKSIQCYMHETGASEEVARQHIKDMMRQMWKKVNAYTADKDSPLTGTTTEFLLNLVRMSHFMYLHGDGHGVQNQETIDVGFTLLFQPIPLEDKHMAFTASPGTKG

SEQ ID NO: 394 - protein, 548 aa, Citrus sinensis; identical to SEQ ID NO: 2
  terpene synthase 1
  ref <308>: DATABASE ACCESSION NUMBER: Genbank Acc. No. ACX70155

SEQ ID NO: 395 - protein, 548 aa, Citrus x paradisi; identical to SEQ ID NO: 291
  putative terpene synthase
  ref <308>: DATABASE ACCESSION NUMBER: Genbank Acc. No. AAM00426

SEQ ID NO: 396 - protein, 559 aa, Crepidiastrum sonochifolium
  germacrene A synthase
  ref <308>: DATABASE ACCESSION NUMBER: Genbank Acc. No. ABB00361
MAAVEANGTLQANTKTTTEPVRPLANFPPSVWGDRFLSFSLDNKELEGYAKAMEEPKEELRRLIVDSTMDSNKKLSLIYSVHRLGLTYLFLQEIEAQLEKLFKEFNLQDYDEVDLYTTSINFQVFRHLGHKLPCDVFNKFKDSTSGKFKEYITNDVKGMLGLYESAQLRVRGESILDEASAFTETKLKSVVNTLEGKLEEQVMQSLRRPFHQGMPMVEARLYFSNYTEECATHASLLKLAKLHFSYLELQQKEELRIVSQWWKDMEFQTSVPYIRDRVPEIYLWILGLYFEPRYSLARIIATKITLFLVVLDDTYDAYATIEEIRLLTDAINRWDISAMEQIPEYIRPFYKILLEEYAELEKQLAKEGREKSVIASKQAFQDIANGYLEEAEWTNSGYVATFPEYMKNGLITSAYNVISKSALVGMGEMVSEHALAWYESHPKTLQASELISRLQDDVMTYQFERERGQSATGVDSYIKTYGVSEKEAIDELNKMIENAWKDINEGCLKPREVSMDVLAPILNLARMIDVVYRYDDGFTFPGKTMKEYTTLLFVGSSPM

SEQ ID NO: 397 - protein, 829 aa, Croton sublyratus
  copalyl diphosphate
  ref <308>: DATABASE ACCESSION NUMBER: Genbank Acc. No. BAA95612
MSSQAFSLLSSLPSSSFSSTRPRLFLGVWYELQGQRISFNLRPRCTDLSITYTNEYVHGEMAVINPPEDDTEEQVPKVTNSICVKFNNKEKKSYIYDYEYNLILKLLIKVAISKEIMRSVERIKKMLKSMEDGEINISAYDTAWVRLVKDVNGSGEPQFPSALQWISNNQLPDGSWGDALVFNAHDRILSTLACVVTLKSWNLHPHKVAKGLKFFKENLSKLEEENEEHMSIGFEVVFPSLLELARKLDIDVPDDSHVLQQICECRNTKLKKIPKDIMHKMPTSLLHSLEGMPDLEWEKLLKLQFDNGSFLFSPSSTAYAFMQTQDDKCLIYLNRIVQRFNGGVPNVYPVDLFEHTWAADRLQRLGISRLFEQELKECMNYVARYWREDGMCWARNSNVRDVDDSSMGFRMLRLYGHNVSADVFKKFKKDDTWVCMPGQSTQAITGMYNLFRASQVLFPGEMILEEAREFCYDFLREKQSANAVVDKWIISKDLPGEVAYALDVPWFASLPTVEARFYIEQYGGDDDVWIGKVLYRMPFVNNNEYLELAKFDYNSCQALHRAEWDNFQKWYDECNLGDFGVSKRELLLAYYISAASIFEPEKSKERLAWAKTSILLQTIDAYFHTNNSIEERKDFVHQFNMELLLPHLEWNRQENGREDKAGTCRNYTWNLKRCPLDALVAHGTDISHSLRHAWEIGLTNWEKDGDKHRGKAELIVKTINLTTGPWVSEELLNCNSKYEKLFQLSNYLYHQLGHFNKNKVDDKKKYTTPEIESSMQELAQLVLQNSSDGLDSNIKQTFFTVVKSIYYTTVCDLGTTNYHMSKVLFERVY

SEQ ID NO: 398 - protein, 789 aa, Cucurbita maxima
  ent-kaurene synthase B
  ref <308>: DATABASE ACCESSION NUMBER: Genbank Acc. No. AAB39482
MYLSRPTGVARFAASSSSSSSASLFPGVDVDTTTKTGALHFEETKERIKKLFDKVELSVSAYDTAWVAMVPSPNSLNQPLFPECINWVLDSQHADGSWGLLHNDQLLMKANLLSTLACVLTLKRWNIGHDHMSKALDFIKSNIASATDENQRSPVGFDIIFPGMIEYAKDLNLNLPLAPTNVDALVRKKELELRSCRSNSEGGKAYLAYVSEGIGKLQDWDMVMQYQRKNGSLFNSPSTTAAAFMHRNDDGCFDYLRSLLQKFDGSVPTIYPLDIYARLHMVDSLQKFGIARHFKEEIRSVLDETYRCWMQGEENIFLDASTCAMAFRMLRVEGYDVSSDQLTQFSEDIFPNCLGGYLKDFGASLELYKASQIITHPDESVLENINSWTSRFLKHGLSSDSVWSDRTDSVVKQEAVNALEFPYNATLERLISKRAMESYSGDIVRISKSPYACLNFGHQDFLELAVEDFNTLQRIHLKELEELQRWVVENKLDELKFFRLHLGYCYFAAAATLTDPELHDARIAWAQNGVLTTVVDDFYDGGGSEEELDNLIELVEKWDPDGEVGYCSKDVEIVFLALHSTVCEIGRRALVWQGRSVMRNVIDGWLALLKVMRKEAEWSTNKVVPSMGEYMEQAHVSFALGPIILPMLFFVGPKLSEEMIGSCEYQKLYKLMSTAGRLKNDIRSYDRECKEGKLNILSLWMIDGGGNVTKEEAIEAIKGDFERAIRELLGLVLQENTTIPRACKDLFWKLMSIVNLFYMEDDGYTSNRLMNTVKAMFEQPMDLDALLNK

SEQ ID NO: 399 - protein, 827 aa, Cucurbita maxima
  copalyl diphospahte synthase 2
  ref <308>: DATABASE ACCESSION NUMBER: Genbank Acc. No. AAD04293
MSSSSSLSLSRHCLSSSFSFRLPNLFPPPAPGGCSLRVKDKGAVLESSIRCIIKCNAISKPPTQDYSDVLQSGVPLLKWQQFVEEGIESETAAQVSVWEEIEERVKWIKSMLSSMDDGDISISAYDTAWVALIPKVTEEGVKSPQFPSSLEWIANNQLPDGSWGDAQIFSPHDRIINTLASLVALKSWNLHPQNTRKGVAFFNQNIWKLEEENAEHMPIGFEIAFPSLLEFAKKLKLGIRSDSPALQQINARRRLKLARIPKDIMHKLPTTLLHSLEGMSGLDWEKLLKLQSQDGSFLSSPASTAFALMHTNHPNCFKYLEASVHRFNGGVPNVYPVDLFEHIWAVDRLQRLGISRFFHPHIVECVNNVRTHWSEKGICWARNSEFRDIDDTAMGFRLLRLYGHDVSAEVFKHFEKDGEFVCIAGQSTQAVTGMLNLYRASDQVMFPGEKILEDAKQFASKFLRQKQAANQLLDKWIIAKDLPGEVGYALDVPWFASLPRVETRLYIQHYGGKNDVWIGKTLYRMFKVNNDTYLELAKLDYNNCQRLHQIEWVDIQKWYTESKLRDYGMRRSSILFSYFGAVCSIFEPERAKERLAWTKTAALVHTIASHYKDANAHQRRAFLQQFTNFHAAQPYDNNAWRSGNMQQKGGEGLVGILLRTLTNISLDILLSHGVDITHHLHQAWQKWVFKWQEDGDVHKEEAELLVQTIILNSGCSTLEDLLSNSQFQKLSNLTNKVCHQLAHFKKHKVNNGNLYKEKTDNKMPPEIEEDIRKLVQLVIQKSSDGNDIDSPIKQTFLTVAKSVYYAAYFDAWTINYHIAKVLFERVF

SEQ ID NO: 400 - protein, 571 aa, Cucumis melo
  terpene synthase
  ref <308>: DATABASE ACCESSION NUMBER: Genbank Acc. No. ABX83200
MSSQVSNFPASIMKTNDIPDVKRSLANFHPNIWKEHFLSFTFDDALKIDEGMKERTEKLKEEIRMMMIAYVENQLIKLNLVDSIQRLGVSYHFEDEVDEFLEHIYVSYNNSLLLSNKNSNGEDLHITALLFRLLRQQGYRISCDIFLKFMDDNGKFKESLVEDERGLLSLYEASHMMGHGEALLEEALEFTTTHLQTYIHRYSNINPSFASEVSNALKLPIRKSVPRIKAREYLEIYQQHPSHNETLLEFSKLDFNILQKLHQKELSEICRWWKDLDVPTKFPFARDRIVECYFWTLGAYFEPQYSVGRKMLTKVIAIASILDDIYDAYGTFEELQVLTPAIQRWDRSMVHTLPLYMKPFYVAMLELYEEIGKEIDKDQNSLHLQVAIGGIKRLSESYFEEAKWLNKEYKPSFKEYMELALKTTGYTMLISISFLGLGDHIVTNEVLQWLSNGPQIIKASTIICRLMDDIASHKFEQEREHVASAVECYMKQYDCSEEEACIELHKEVVDAWKDTNEAFYRPFNVPVPVLMRVLNFSRVINLLYLDEDGYTNAKSGTKFLIKSLLVDPLPC

SEQ ID NO: 401 - protein, 561 aa, Elaeis oleifera
  sesquiterpene synthase
  ref <308>: DATABASE ACCESSION NUMBER: Genbank Acc. No. AAC31570
MSSNTMEAHGSTNHSSVPCGGDGTIRFLANFHPTIWGDYFIENYPLPSNLQKSEACIEKRREELKVEVMNLLKNANDYLQEMELIDILQRLGVAYHFEKKIDEILSQIFKEHMEDDNLHAVALRFRLLRQHGYNMPTNIFIKFKEVDGSFKATLRNDVKGLLSLYEAAYLGIPKDNLLDEALNFAKLHLKSMESHMKTPLAVRVLDAFEMPLHRRTTRLEAKNYISIYQQDDGRINVVLELAKLDFHILQSIHREEVRSISMWWKALGLAKKLTFCRDRVVEGYFWILGVYFEPQYSRARIYLTKVLALLSIMDDIYDTYGIAEELQAFTEVIRRWDIEAVDQLDEVYKLYFLNLYNTFKEFEDELAKEGNSYRVEYLKESVKELSRAYLEEVKWRDEGYVPPLKEYLNVSQISTVHVALSCASFVGMGEEATKEAFDWVTSFPRIIKSSCLIGRLLDDVASNEFEHERKHVSSAVHCYIKEHGTSVQEAYEKLRGMIEDEWKIMNQEYLCMTTMPMSLIRPIINLPRMAETVYKKCDSYTHSLSTMKDYIMSLLVEPISF

SEQ ID NO: 402 - protein, 873 aa, Ginkgo biloba
  levopimaradiene synthase
  ref <308>: DATABASE ACCESSION NUMBER: Genbank Acc. No. AAL09965
MAGVLFANLPCSLQLSPKVPFRQSTNILIPFHKRSSFGFNAQHCVRSHLRLRWNCVGIHASAAETRPDQLPQEERFVSRLNADYHPAVWKDDFIDSLTSPNSHATSKSSVDETINKRIQTLVKEIQCMFQSMGDGETNPSAYDTAWVARIPSIDGSGAPQFPQTLQWILNNQLPDGSWGEECIFLAYDRVLNTLACLLTLKIWNKGDIQVQKGVEFVRKHMEEMKDEADNHRPSGFEVVFPAMLDEAKSLGLDLPYHLPFISQIHQKRQKKLQKIPLNVLHNHQTALLYSLEGLQDVVDWQEITNLQSRDGSFLSSPASTACVFMHTQNKRCLHFLNFVLSKFGDYVPCHYPLDLFERLWAVDTVERLGIDRYFKKEIKESLDYVYRYWDAERGVGWARCNPIPDVDDTAMGLRILRLHGYNVSSDVLENFRDEKGDFFCFAGQTQIGVTDNLNLYRCSQVCFPGEKIMEEAKTFTTNHLQNALAKNNAFDKWAVKKDLPGEVEYAIKYPWHRSMPRLEARSYIEQFGSNDVWLGKTVYKMLYVSNEKYLELAKLDFNMVQALHQKETQHIVSWWRESGFNDLTFTRQRPVEMYFSVAVSMFEPEFAACRIAYAKTSCLAVILDDLYDTHGSLDDLKLFSEAVRRWDISVLDSVRDNQLKVCFLGLYNTVNGFGKDGLKEQGRDVLGYLRKVWEGLLASYTKEAEWSAAKYVPTFNEYVENAKVSIALATVVLNSIFFTGELLPDYILQQVDLRSKFLHLVSLTGRLINDTKTYQAERNRGELVSSVQCYMRENPECTEEEALSHVYGIIDNALKELNWELANPASNAPLCVRRLLFNTARVMQLFYMYRDGFGISDKEMKDHVSRTLFDPVA

SEQ ID NO: 403 - protein, 555 aa, Gossypium arboreum
  (+)-delta-cadinene synthase
  ref <308>: DATABASE ACCESSION NUMBER: Genbank Acc. No. CAA77191
MASQASQVLASPHPAISSENRPKADFHPGIWGDMFIICPDTDIDAATELQYEELKAQVRKMIMEPVDDSNQKLPFIDAVQRLGVSYHFEKEIEDELENIYRDTNNNDADTDLYTTALRFRLLREHGFDISCDAFNKFKDEAGNFKASLTSDVQGLLELYEASYMRVHGEDILDEAISFTTAQLTLALPTLHHPLSEQVGHALKQSIRRGLPRVEARNFISIYQDLESHNKSLLQFAKIDFNLLQLLHRKELSEICRWWKDLDFTRKLPFARDRVVEGYFWIMGVYFEPQYSLGRKMLTKVIAMASIVDDTYDSYATYDELIPYTNAIERWDIKCMNQLPNYMKISYKALLDVYEEMEQLLANQGRQYRVEYAKKAMIRLVQAYLLEAKWTHQNYKPTFEEFRDNALPTSGYAMLAITAFVGMGEVITPETFKWAASDPKIIKASTIICRFMDDIAEHKFNHRREDDCSAIECYMKQYGVTAQEAYNEFNKHIESSWKDVNEEFLKPTEMPTPVLCRSLNLARVMDVLYREGDGYTHVGKAAKGGITSLLIDPIQI

SEQ ID NO: 404 - protein, 554 aa, Gossypium arboreum
  (+)-delta-cadinene synthase
  ref <308>: DATABASE ACCESSION NUMBER: Genbank Acc. No. CAA76223
MASQVSQMPSSSPLSSNKDEIRPKADFQPSIWGDFFLNCPDKNIDAGTEKRHQQLKEEVRKMIVAPMANSTQKLAFIDSVQRLGVSYHFTKEIEDELENIYHNNNDAENDLYTTSLRFRLLREHGYNVSCDVFNKFKDEQGNFKSSVTSDVQGLLELYQASYLRVHGEDILDEAISFTTNHLSLAVSSLDHPLSEEVSHALKQSIRRGLPRVEARHYLSVYQDIESHNKALLEFAKIDFNMLQFLHRKELSEICRWWKDLDFQRKLPYARDRVVEGYFWISGVYFEPQYSLGRKMLTKVIAMASIVDDTYDSYATYEELIPYTNAIERWDIKCIDELPEYMKPSYKALLDVYKEMEQLVAEHGRQYRVEYAKNAMIRLAQSYLVEARWTLQNYKPSFEEFKANALPTCGYAMLAITSFVGMGDIVTPETFKWAANDPKIIQASTIICRFMDDVAEHKFKHRREDDCSAIECYMEEYGVSAQEAYDVFNKHVESAWKDVNQEFQKPTEMPTEVLNRSLNLARVMDVLYREGDGYTYVGKAAKGGITSLLIEPIAL

SEQ ID NO: 405 - protein, 555 aa, Gossypium arboreum
  (+)-delta-cadinene synthase isozyme A
  ref <308>: DATABASE ACCESSION NUMBER: Genbank Acc. No. AAB4129
MASQASQVLASPHPAISSENRPKADFHPGIWGDMFIICPDTDIDAATELQYEELKAQVRKMIMEPVDDSNQKLPFIDAVQRLGVSYHFEKEIEDELENIYRDTNNNDADTDLYTTALRFRLLREHGFDISCDAFNKFKDEAGNFKASLTSDVQGLLELYEASYMRVHGEDILDEAISFTTAQLTLALPTLHHPLSEQVGHALKQSIRRGLPRVEARNFISIYQDLESHNKSLLQFAKIDFNLLQLLHRKELSEICRWWKDLDFTRKLPFARDRVVEGYFWIMGVYFEPQYSLGRKMLTKVIAMASIVDDTYDSYATYDELIPYTNAIERWDIKCMNQLPNYMKISYKALLNVYEEMEQLLANQGRQYRVEYAKKAMIRLVQAYLLEAKWTHQNYKPTFEEFRDNALPTSGYAMLAITAFVGMGEVITPETFKWAASDPKIIKASTIICRFMDDIAEHKFNHRREDDCSAIECYMKQYGVTAQEAYNEFNKHIESSWKDVNEEFLKPTEMPTPVLCRSLNLARVMDVLYREGDGYTHVGKAAKGGITSLLIDPIQI

SEQ ID NO: 406 - protein, 554 aa, Gossypium arboreum
  (+)-delta-cadinene synthase isozyme XC1
  ref <308>: DATABASE ACCESSION NUMBER: Uniprot Acc. No. Q39761
MASQVSQMPSSSPLSSNKDEMRPKADFQPSIWGDLFLNCPDKNIDAETEKRHQQLKEEVRKMIVAPMANSTQKLAFIDSVQRLGVSYHFTKEIEDELENIYHNNNDAENDLYTTSIRFRLLREHGYNVSCDVFNKFKDEQGNFKSSVTSDVRGLLELYQASYLRVHGEDILDEAISFTTHHLSLAVASLDHPLSEEVSHALKQSIRRGLPRVEARHYLSVYQDIESHNKALLEFAKIDFNMLQFLHRKELSEICRWWKDLDFQRKLPYARDRVVEGYFWISGVYFEPQYSLGRKMLTKVIAMASIVDDTYDSYATYEELIPYTNAIERWDIKCIDEIPEYMKPSYKALLDVYEEMVQLVAEHGRQYRVEYAKNAMIRLAQSYLVEAKWTLQNYKPSFEEFKANALPTCGYAMLAITSFVGMGDIVTPETFKWAASDPKIIQASTIICRFMDDVAEHKFKHRREDDCSAIECYMEEYGVTAQEAYDVFNKHVESAWKDLNQEFLKPTEMPTEVLNRSLNLARVMDVLYREGDGYTYVGKAAKGGITSLLIEPIAL

SEQ ID NO: 407 - protein, 554 aa, Gossypium arboreum
  (+)-delta-cadinene synthase isozyme XC14
  ref <308>: DATABASE ACCESSION NUMBER: Genbank Acc. No. AAA93065
MASQVSQMPSSSPLSSNKDEMRPKADFQPSIWGDLFLNCPDKNIDAETEKRHQQLKEEVRKMIVAPMANSTQKLAFIDSVQRLGVSYHFTKEIEDELENIYHNNNDAENDLYTTSLRFRLLREHGFNVSCDVFNKFKDEQGNFKSSVTSDVRGLLELYQASYLRVHGEDILDEAISFTTNHLSLAVASLDYPLSEEVSHALKQSIRRGLPRVEARHYLSVYQDIESHNKVLLEFAKIDFNMVQLLHRKELSEISRWWKDLDFQRKLPYARDRVVEGYFWISGVYFEPQYSLGRKMLTKVIAMASIVDDTYDSYATYEELIPYTKAIERWDIKCIDELPEYMKPSYKALLDVYEEMEQLVAKHGRQYRVEYAKNAMIRLAQSYLVEARWTLQNYKPSFEEFKANALPTCGYAMLAITSFVGMGDIVTPETFKWAANDPKIIQASTIICRFMDDVAEHKFKHRREDDCSAIECYMEEYGVTAQEAYDVFNKHVESAWKDVNKEFLKPTEMPTEVLNRSLNLARVMDVLYREGDGYTYVGKAAKGGITSLLIEPVAL

SEQ ID NO: 408 - protein, 554 aa, Gossypium hirsutum
  (+)-delta-cadinene synthase
  ref <308>: DATABASE ACCESSION NUMBER: Genbank Acc. No. AAC12784
MASQVSQMPSSSPLSSNKDEMRPKADFQPSIWGDFFLNCPDKNIDAETQKRHQQLKEEVRKMIVAPMANSTLKLAFIDSVQGLGVSYHFTKEIEDELENIYHNNNDAENDLYTTSLRFRLLREHGFHVSCDVFNKFKDEQGNFKSSVTSDVRGLLELYQASYLRVHGEDILDEAISFTSNHLSLAVASLDHPLSEEVSHALKQSIRRGLPRVEARHYLSVYQDIESHNKVLLEFAKIDFNMVQLLHRKELSEISRWWKDLDFQRKLPYARDRVVEGYFWISGVYFEPQYSLGRKMLTKVIAMASIVDDTYDSYATYEELIPYTNAIERWDIKCIDELPEYMKPSYKALLDVYEEMEQLVAEHGRQYRVEYAKNAMIRLAQSYLVEARWTLQNYKPSFEEFKANALPTCGYAMLAITSFVGMGDIVTPETFKWAANDPKIIQASTIICRFMDDVTEHKFKHRREDDCSAIECYMEEYGVTAQEAYDVFNKHVESAWKDVNQGFLKPTEMPTEVLNRSLNLARVMDVLYREGDGYTYVGKAAKGGITSLLIEPIAL

SEQ ID NO: 409 - protein, 554 aa, Gossypium hirsutum
  (+)-delta-cadinene synthase
  ref <308>: DATABASE ACCESSION NUMBER: Genbank Acc. No. AAX44033
MASQVSQMPSSSPLSSNKDEMRPKADFQPSIWGDFFLNCPDKNIDAETQKRHQQLKEEVRKMIVAPMANSTQKLAFIDSVQRLGVSYHFTKEIEDELENIYHNNNDAENDLYTTSLRFRLLREHGFNVSCDVFNKFKDEQGNFKSSVTSDVRGLLELYQASYLRVHGEDILDEAISFTSNHLSLAVASLDHPLSEEVSHALKQSIRRGLPRVEARHYLSVYQDIESHNKVLLEFAKIDFNMVQLLHRKELSEISRWWKDLDFQRKLPYARDRVVEGYFWISGVYFEPQYSLGRKMLTKVIAMASIVDDTYDSYATYEELIPYTNAIERWDIKCIDELPEYMKPSYKALLDVYEEMEQLVAEHGRQYRVEYAKNAMIRLAQSYLVEARWTLQNYKPSFEEFKANALPTCGYAMLAITSFVGMGDIVTPETFKWAANDPKIIQASTIICRFMDDVAEHKFKHRREDDCSAIECYMEEYGVTAQEAYDVFNKHVESAWKDVNQEFLKPTEMPTEVLNRSLNLARVMDVLYREGDGYTYVGKAAKGGITSLLIEPIAL

SEQ ID NO: 410 - protein, 551 aa, Gossypium hirsutum
  (+)-delta-cadinene synthase
  ref <308>: DATABASE ACCESSION NUMBER: Genbank Acc. No. AAF74977
QVSQMPSSSPLSSNKDEMRPKADFQPSIWGDFFLNCPDKNIDAETQKRHQQLKEEVRKMIVAPMANSTQKLAFIDSVQRLGVSYHFTKEIEDELENIYHNNNDAENDLYTTSLRFRLLREHGFNVSCDVFNKFKDEQGNFKSSVTSDVRGLLELYQASYLRVHGEDILDEAISFTSNHLSLAVASLDHPLSEEVSHALKQSIRRGLPRVEARHYLSVYQDIESHNKVLLEFAKIDFNMVQLLHRKELSEISRWWKDLDFQRKLPYARDRVVEGYFWISGVYFEPQYSLGRKMLTKVIAMASIVDDTYDSYATYEELIPYTNAIERWDIKCIDELPEYMKPSYKALLDVYEEMEQLVAEHGRQYRVEYAKNAMIRLAQSYLVEARWTLQNYKPSFEEFKANALPTCGYAMLAITSFVGMGDIVTPETFKWAANDPKIIQASTIICRFMDDVAEHKFKHRREDDCSAIECYMEEYGVTAQEAYDVFNKHVESAWKDVNQEFLKPTEMPTEVLNRSLNLARVMDVLYREGDGYTYVGKAAKGGITSLLIEPIAL

SEQ ID NO: 411 - protein, 554 aa, Gossypium hirsutum
  (+)-delta-cadinene synthase
  ref <308>: DATABASE ACCESSION NUMBER: Genbank Acc. No. AAX44034
MAKQVSQLLSSSPLTSNKDEMRLKADFQPSIWGDLFLTCLDNDIDAETEQRHQQLEGGVRKMIVAPMANSTQKLTFIDSVQRLGVSYRFTKEIEDELENIYHNNNDAENDLYTTSLRFRLLREHGFNVSCEVFNKFKDEQGDFKSSLTSDVRGLLELYEASYLRVHGEDILDEAISFTTDHLTLAVATLEYPLSEHVSHALKKSIRRGLPRIEARHYLSVYQDIESHNTALLEFAKIDFNMLQLLHRKELSEICRWWKDLDFKRKLPYVRDRVVECFFWILGVYFEPQYSLGRKILTKVIAMTSVIDDTYDSYATYDELIPYTNAIERWDIKCIDQLPEYMKLSYKALLDVYEEMEQLMAEDGRQYRVEYAKNIMIQLAQAFLMEAKWTLQNHKPSFEEFKATALQTTGYAMLAITALVDMGDIVTPETFTWAANNPKIIQASTIICRFMDDVAEHKFKQRREDDFSGIECYMEEYGVMVQEAYNVFYKHIESAWKDVNKGFLKPTEMPIEVLNRILNLARVMNVLYNEGDGYTYVGKATKGIISILLIEPVTL

SEQ ID NO: 412 - protein, 559 aa, Helianthus annuus
  germacrene A synthase 1
  ref <308>: DATABASE ACCESSION NUMBER: Genbank Acc. No. ACA14463
MAAVGASATPLTNTKSTAEPVRPVANFPPSVWGDLFLSFSLDKSIMEEYAEAMEEPKEQVRRLILDPTMDSNKKLSLIYTVHRLGLTYMFLKEIEAQLDRLFKEFNLEDYVELDLYTISINFQAFRHLGYKLPCDVFNKFKNDDSTTFKESITGDVRGMLGLYESAQLRLKGENILDEASAFAETKLKSLVNTLEGSLAQQVKQSLRRPFHQGMPMVEARLYFSNYQEECSAHDSILKLAKLHFNYLQLQQKEELRIVSQWWKDMRFQETTPYIRDRVPEIYLWILGLYFEPRYSLARIIATKITLFLVVLDDTYDAYATIEEIRLLTDAINRWDISAMNQIPEYIRPFYKILLDEYAELEKQLAKEGRANSVIASKEAFQDIARGYLEEAEWTNSGYVASFPEYMKNGLITSAYNVISKSALVGMGEIVSEDALVWYESHPQILQASELISRLQDDVMTYQFERERGQSATGVDSYIKTYGVSEKVAIDELKKMIENAWKEINEGCLKPREVSMDLLAPILNLARMIDVVYRYDDGFTFPGKTLKEYITLLFVGSSPM

SEQ ID NO: 413 - protein, 559 aa, Helianthus annuus
  germacrene A synthase 2
  ref <308>: DATABASE ACCESSION NUMBER: Genbank Acc. No. ABY49939
MAAVGASATLLTNTKSAEEPVRPVANFPPSVWGDLFLSFSLDNSMMEEYAEAMEEPKGQVRKLILDPTMDSNKKLSLIYTVHRLGLTYMFFKEIEGQLDRLFKEFNLEDYVEVDLYTISTNFQAFRHLGYKLSCDVFNKFKNYDSNTFKESITSDVRGMLGLYESAQLRLKGEKILDEASAFTETKLKSLVKTLEGSLAQQVKQSLKRPFHQGMPMVEARLYFSNYQEECSRHDSLLKLAKLHFNYLQLQQKEELRIVSQWWKDMRFQETTPYIRDRVPEIYLWILGLYFEPRYSLARIIATKITLFLVVLDDTYDAYATIEEVRLLTDAINRWDIGAMSQIPEYIRPFYKILLDEYAELEKQLAKEGRANSVIASKEAFQDIARGYLEEAEWTNSGYVASFPEYMKNGLITSAYNVISKSALVGMGEIVSEDALAWYESHPQILQASELISRLQDDVMTYQFERERGQSATGVDAYIKTYGVSEKEAIDELKKMIENAWKEINEGCLKPREVSMDLLAPILNLARMIDVVYRYDDGFTFPGKTLKEYITLLFVGSSPM

SEQ ID NO: 414 - protein, 557 aa, Helianthus annuus
  germacrene A synthase 3
  ref <308>: DATABASE ACCESSION NUMBER: Genbank Acc. No. ACZ50512
MAAVDTNATIQEKTTAGPVRPLANFPPSVWGDRFLSFTLDNSELEGYAKAMEAPKEELRRLIVDQTMDSNKKLSLIYSVHRLGLTYLFLQEIEAQLDKIFKEFNLQDYDEVDLYTTSINFQVFRHLGYKLPCDVFNKFKDNTSGAFKEDISTDVKGMLGLYESSQLRTRGESILDEASSFTETKLKSVVNNLEGNLAQQVLQSLRRPFHQGMPMVEARLYFSNYSEECATHECLLKLAKLHFSYLELQQKEELRIVSKWWKDMRFQETTPYIRDRVPEIYLWILGLYFEPRYSLARIIATKITLFLVVLDDTYDAYATIEEIRLLTDAINRWDMSAMEQIPEYIRPFYKILLDEYAELEKQLAIEGRAKSVIASKEAFQDIARGYLEEAEWTNSGYVASFPEYMKNGLITSAYNVISKSALVGMGDIVSENALAWYESHPKTLQASELISRLQDDVMTYQSERERGQSATGVDAYIKTYGVSEKEAIDELKIMIENAWKDINEGCLKPREVSMDLLAPILNLARMIDVVYRYDDGFTFPGKTMKEYITLLFVGSVSM

SEQ ID NO: 415 - protein, 555 aa, Helianthus annuus
  gamma-cadinene synthase
  ref <308>: DATABASE ACCESSION NUMBER: Genbank Acc. No. AAY41422
MATTEANTMAQANSQTTIEPVRHLANFPPSIWGDQFLSFSLDNSQLEAYSKAMEQPKENVRRMILNPAIDTNEKLGLIYCVYRLGLTYNFSKDIDGQLDELFKQLNLQSYNEADLYTISIHFQVFRHFGYRFSCDVFNKFKDSSSGKFKEDMTRDVRGMISLYESAQLRIRGESILDEAGAFAESKLKTIEKTLDGTLAQQVKHVLERPFNRGHQMVEARKYLFLFEEEISRYDSLLMLAKVHFNYLQLLQKEELRSVSKWWKDLDLPAKTLYVRDRVPELYVWILAFFLEPYYSEVRIITTKIVLLVLVLDDTYDAYATIEESRLLTHAINRWEVSAMLQLPEYMKPLYEILLNEYDGFYKHGRTNVIETSKKAFQDLARSYHQESEWRHAKEVPSFEEYMKIGTTTSAHNVLSKTALIGMGNIVTREALAWYESYPKIVQLSELIGRLEDDVVSVEFERERAPTATSVDAYMKTYGVSENVAVKILKKLVENGWKDLNEACLKPTEVSLDLLAPIIGLTNMTDVAYRHNDGLTFPEKTLKEYITLLFCVPVPM

SEQ ID NO: 416 - protein, 350 aa, Hyoscyamus muticus
  vetispiradiene synthase
  ref <308>: DATABASE ACCESSION NUMBER: Genbank Acc. No. AAA86339
LHKSIPRVETRYFITIYEEEELKNDVLLRFAKLDFNLLQMLHKQELTEVSMWWKDLDFVTTLPYARDRAVECYFWTVGVYAEPQYSEARVMLAKTIAMISIVDDTFDAYGIVKELEVYTDAIQRWDINQIDRLPDYMKISYKVLLDLYKDYETELSKDGRSEVVHYAKERMKEIVRNYFVEAKWFIEGYMPPVSEYLNNRLATSTYYLLTTTSYLGMKCANKEDFEWLTKNPKILEANVTLCRVIDDIATYEVEKGRGQIATGIECYMRDYGVSTEEAMEKFQEMAEIAWKDVNEGILRPTPVSAKILTRILNLARIIDVTYLHNQDGYTHPEKVLKPHIIALVVDSIEI

SEQ ID NO: 417 - protein, 311 aa, Kitasatospora griseola
  diterpene cyclase-2
  ref <308>: DATABASE ACCESSION NUMBER: Genbank Acc. No. BAB39207
MPDAIEFEHEGRRNPNSAEAESAYSSIIAALDLQESDYAVISGHSRIVGAAALVYPDADAETLLAASLWTACLIVNDDRWDYVQEDGGRLAPGEWFDGVTEVVDTWRTAGPRLPDPFFELVRTTMSRLDAALGAEAADEIGHEIKRAITAMKWEGVWNEYTKKTSLATYLSFRRGYCTMDVQVVLDKWINGGRSFAALRDDPVRRAIDDVVVRFGCLSNDYYSWGREKKAVDKSNAVRILMDHAGYDESTALAHVRDDCVQAITDLDCIEESIKRSGHLGSHAQELLDYLACHRPLIYAAATWPTETNRYR

SEQ ID NO: 418 - protein, 566 aa, Antirrhinum majus
  (3S)-(E)-nerolidol synthase
  ref <308>: DATABASE ACCESSION NUMBER: Genbank Acc. No. ABR24417
MSNLHVKKTDRIASGFDVAYLSAANKTHQWSIADDIASTPGSPRLHYPMDFNGQSTRTPDNFSMEYDKKIEEIKNLLRSKREEEPIDRLMFVDAIQRLGVNHNFEELIETILRNYYESTSANICGFHTLHDVSLFFRLMRQHGYDISSDVFNKFKGDDGRFRGELQRDTRGLMELYEASQLRFEGEYTLDEAESFSSQNLNKYLADMDCSSCRLVTNKLQHPYRKSIGRLTTRYDFRGKNQWGKTLHELAAMDLRMRKSEYQKELFQVSEWWKELRIAENLSLARNQPLKWYTCSMAILIDDITLSEQRIELTKSITFIYLIDDIFDVYGSPEELVIFAEAVSKWDYAAVETLPDYMKLCYKSLLDTTNEIGYKIYEKYGYNPIDSLKTTWASLCNAFLEEAKWFASGNLPNATKYLENGKVSSGVYVVMVHLFFLLGLGGTCGSAIHLNDTSKLMSSVATILRLWDDLGSAKDEHQDGKDGSYIECYMKEHISLSTEQAQQHAIDLISSEWKLLNKECFNLNHVSTSSIKKAALNTARMVPLMYSYDENQGLPILEEYVKIMLFD

SEQ ID NO: 419 - protein, 547 aa, Arabidopsis thaliana; identical to SEQ ID NO: 374
  (-)-E-beta-caryophyllene synthase
  ref <308>: DATABASE ACCESSION NUMBER: Genbank Acc. No. AAO85539

SEQ ID NO: 420 - protein, 524 aa, Arabidopsis thaliana
  (Z)-gamma-bisabolene synthase
  ref <308>: DATABASE ACCESSION NUMBER: NCBI Acc. No. NP_193064
MESQTTFKYESLAFTKLSHCQWTDYFLSVPIDESELDVITREIDILKPEVMELLSSQGDDETSKRKVLLIQLLLSLGLAFHFENEIKNILEHAFRKIDDITGDEKDLSTISIMFRVFRTYGHNLPSSVFKRFTGDDGKFQQSLTEDAKGILSLYEAAHLGTTTDYILDEALKFTSSHLKSLLAGGTCRPHILRLIRNTLYLPQRWNMEAVIAREYISFYEQEEDHDKMLLRLAKLNFKLLQLHYIKELKSFIKWWMELGLTSKWPSQFRERIVEAWLAGLMMYFEPQFSGGRVIAAKFNYLLTILDDACDHYFSIHELTRLVACVERWSPDGIDTLEDISRSVFKLMLDVFDDIGKGVRSEGSSYHLKEMLEELNTLVRANLDLVKWARGIQTAGKEAYEWVRSRPRLIKSLAAKGRLMDDITDFDSDMSNGFAANAINYYMKQFVVTKEEAILECQRMIVDINKTINEELLKTTSVPGRVLKQALNFGRLLELLYTKSDDIYNCSEGKLKEYIVTLLIDPIRL

SEQ ID NO: 421 - protein, 554 aa, Arabidopsis thaliana
  (Z)-gamma-bisabolene synthase
  ref <308>: DATABASE ACCESSION NUMBER: NCBI Acc. No. NP_193066
MESQTKFDYESLAFTKLSHSQWTDYFLSVPIDDSELDAITREIDIIKPEVRKLLSSKGDDETSKRKVLLIQSLLSLGLAFHFENEIKDILEDAFRRIDDITGDENDLSTISIMFRVFRTYGHNLPSSVFKRFTGDDGKFERSLTEDAKGILSLYEAAHLGTTTDYILDEALEFTSSHLKSLLVGGMCRPHILRLIRNTLYLPQRWNMEAVIAREYISFYEQEEDHDKMLLRLAKLNFKLLQLHYIKELKTFIKWWMELGLTSKWPSQFRERIVEAWLAGLMMYFEPQFSGGRVIAAKFNYLLTILDDACDHYFSIPELTRLVDCVERWNHDGIHTLEDISRIIFKLALDVFDDIGRGVRSKGCSYYLKEMLEELKILVRANLDLVKWARGNQLPSFEEHVEVGGIALTTYATLMYSFVGMGEAVGKEAYEWVRSRPRLIKSLAAKGRLMDDITDFESDMSNGFAANAINYYMKQFVVTKEEAILECQKMVVDINKIVNEELLKTTTVPRRVLKQALNFGRLLEVLYTKSDDIYNCSEGKLKEYIVTLLIDPIHL

SEQ ID NO: 422 - protein, 574 aa, Artemisia annua
  (E)-beta-farnesene synthase
  ref <308>: DATABASE ACCESSION NUMBER: Genbank Acc. No. AAX39387
MSTLPISSVSFSSSTSPLVVDDKVSTKPDVIRHTMNFNASIWGDQFLTYDEPEDLVMKKQLVEELKEEVKKELITIKGSNEPMQHVKLIELIDAVQRLGIAYHFEEEIEEALQHIHVTYGEQWVDKENLQSISLWFRLLRQQGFNVSSGVFKDFMDEKGKFKESLCNDAQGILALYEAAFMRVEDETILDNALEFTKVHLDIIAKDPSCDSSLRTQIHQALKQPLRRRLARIEALHYMPIYQQETSHDEVLLKLAKLDFSVLQSMHKKELSHICKWWKDLDLQNKLPYVRDRVVEGYFWILSIYYEPQHARTRMFLMKTCMWLVVLDDTFDNYGTYEELEIFTQAVERWSISCLDMLPEYMKLIYQELVNLHVEMEESLEKEGKTYQIHYVKEMAKELVRNYLVEARWLKEGYMPTLEEYMSVSMVTGTYGLMIARSYVGRGDIVTEDTFKWVSSYPPIIKASCVIVRLMDDIVSHKEEQERGHVASSIECYSKESGASEEEACEYISRKVEDAWKVINRESLRPTAVPFPLLMPAINLARMCEVLYSVNDGFTHAEGDMKSYMKSFFVHPMVV

SEQ ID NO: 423 - protein, 547 aa, Artemisia annua
  (8)-epi-cedrol synthase
  ref <308>: DATABASE ACCESSION NUMBER: Genbank Acc. No. AAF80333
MSLIVEDVIRPNANFPSEIWGDQFLAYDQDEQEGVEQVIKDLKEEVKSELLTALNSPTQHTELLKFIDAIERLGIAYYFEEEINQVFQHMYTAYGDKWTGGNTSLWFRLMRQHGFFVSSDIFSTYKDKEGRFKESLEKDVHGLLELYEAAYMFVPGEGILDDALVFTRTCLDEIAKNPSLSNSAVSSQIREALTQPLHKRLPRLEALRYIPFYQQQASHSETLLKLAKLGFNQLQSLHKKELSIISKWWKSFDVANNLPYARNRPVECYFWALAVYFEPQYSESRVFLSRFFSIQTFLDDTYDAYGTYEELEQFTEAIQRWSITCLDGLPESMKLIFQMLVKIFEEIEEILSKDGKQHHVNYIKETLKEAVQSYMTEARWAKEEYIPTIEEHTKVSYISIGYKLALVAGFACMGDVIADDSFEWVFTNPPLVNACCLLCRTMDDLGSHKGEQDRKHVASTIECYMKQFDASEQQAYESLNKKVEDAWKEINREFMITCKDVNIHVAMRVLNFSRSVDVLYKNKDHFTHVGVEVINHIKSLFVDAIIT

SEQ ID NO: 424 - protein, 547 aa, Artemisia annua; identical to SEQ ID NO: 423
  (8)-epi-cedrol synthase
  ref <308>: DATABASE ACCESSION NUMBER: Genbank Acc. No. CAC08805

SEQ ID NO: 425 - protein, 548 aa, Artemisia annua
  ((E)-beta-caryophyllene synthase
  ref <308>: DATABASE ACCESSION NUMBER: Genbank Acc. No. AAL79181
MSVKEEKVIRPIVHFPPSVWADQFLIFDDKQAEQANVEQVVNELREDVRKDLVSSLDVQTEHTNLLKLIDAIQRLGIAYHFEEEIEQALQHIYDTYGDDWKGRSPSLWFRILRQQGFYVSCDIFKNYKKEDGSFKESLTNDVEGLLELYEATYLRVQGEGVLDDALVFTRTCLEKIAKDLVHTNPTLSTYIQEALKQPLHKRLTRLEALRYIPMYEQQASHNESLLKLAKLGFNLLQSLHRKELSEVSRWWKGLDVPNNLPYARDRMVECYFWALGVYFEPKYSQARIFLAKVISLATVLDDTYDAYGTYEELKIFTEAIQRWSITCIDMLPEYLKLLYQGVLDIYIEMEEIMGKEGKAHHLSYAKESMKEFIRSYMMEAKWANEGYVPTAEEHMSVAFVSSGYSMLATTCFVGMGDIVTDEAFKWALTKPPIIKASCAIARLMDDIHSQKEEKERIHVASSVESYMKQYDVTEEHVLKVFNKKIEDAWKDITRESLVRKDIPMPLMMRVINLAQVMDVLYKHKDGFTNVGEELKDHIKSLLVHPIPI

SEQ ID NO: 426 - protein, 320 aa, Aspergillus terreus
  aristolochene synthase
  ref <308>: DATABASE ACCESSION NUMBER: Genbank Acc. No. AAF13263
MKKPNGTNGASSSLEPPPSTFQPLCHPLVEEVSKEVDGYFLQHWNFPNEKARKKFVAAGFSRVTCLYFPKALDDRIHFACRLLTVLFLIDDLLEYMSFEEGSAYNEKLIPISRGDVLPDRSIPVEYIIYDLWESMRAHDREMADEILEPVFLFMRAQTDRTRARPMGLGGYLEYRERDVGKELLAALMRFSMGLKLSPSELQRVREIDANCSKHLSVVNDIYSYEKELYTSKTAHSEGGILCTSVQILAQEADVTAEAAKRVLFVMCREWELRHQLLVARLSAEGLETPGLAAYVEGLEYQMSGNELWSQTTLRYSVVVD

SEQ ID NO: 427 - protein, 560 aa, Cucumis melo
  alpha-farnesene synthase
  ref <308>: DATABASE ACCESSION NUMBER: Genbank Acc. No. ABX83201
MSSNISAIPNSLEVIRRSAQFQASVWGDYFLSYHSLSPEKGNKVMEKQTEELKEEIKRELNSTTKDEEPEKLRLIDSIQRLGVCYHFEYEINKILEQLHHITITSKNNGDDHPYNMTLRFRLLRQQGYNISSKSFERFRGKWESSYDKNVEELLSLYEASQLRMRGEEALDEAFRFATAQLEAIVQDPTTDPTVVGEVCQALKWPMYKNLPRLQASHYIGLYSEKPWRNESLPNFAKMDFSKLQKLHQKEIAYISKWWDDYGFAEKLSFARNRIVEGYFFALGIFFEPQLSTARLIMTKIIAIGSVLDDIYDVYGTFEELKLLTLALERWDKSETKKLPKYMKMYYEALLDVFEEIEQEMSQKETTPYCIHQMKEATKELGRVFLVEAKWCKEGYTPTVEEYLDIALISFGHKLLMVTALLGMGSTIATQQIVQWITSMPNILKASAIICRLMNDIVSHKFEQERGHVASAIECYMEQNYMSEHDVLIILGKQIDEFWKDMVENYCVVITEEEVPRGVLMRVLNLTRLFNVIYKDGDGYTQSHGSTKTHIKSLLVDSLPL

SEQ ID NO: 428 - protein, 567 aa, Cucumis sativus
  (E,E)-alpha-caryophyllene synthase
  ref <308>: DATABASE ACCESSION NUMBER: Genbank Acc. No. AAU05952
MSSHFPASIMKTNDIYDTKRSLANFHPTIWKEHFLSFTFDDALKVDGGMKERIEKLKEEIRMMVIASVQNPLVKLNLVDSIQRLGVSYHFEDEIDQFLEHMYVSYNNSLLFSSNDSQDDDLHISALLFRLLRQHGYRISCDIFLKFMDNNGKFKESLVEDERGILSLYEASHMRGHGEALLEEALEFTTTHLKAYIHLYSNINPNFASEVSNALKLPIRKCVPRVKAREYFEIYQQQPSHNETLLTFSKLDFNILQKLHQKEIAEICRWWKDLNVSTNFPFARDRIVECYFWILSIYFEPYFKFGRKILTKVIAMTSIMDDIYDAYGTFEELQLFTLAIKRWDMSMVNLLPQYMKVHYTTLLDLFEEMDKGIVNDGISYRSCFGKEAMKRQAESYFKEAEWLNKNYKPKYGEYMEVALASSGYELLSTISFVCMGDIATKEVFEWLFDCPQILKASTTISRLMDDVVSYKFEKEREHIVSAVECYMSNHGRSEDETCAELLKQVEDAWKTINECCLHPMNVPMPFLICLLNLTRVMALLYSHEDGYTNSKGRTKLLIQSLLIDPLHL

SEQ ID NO: 429 - protein, 561 aa, Cucumis sativus
  (E)-alpha-farnesene synthase
  ref <308>: DATABASE ACCESSION NUMBER: Genbank Acc. No. AAU05951
MSSNVSAIPNSFELIRRSAQFQASVWGDYFLSYHSLPPEKGNKVMEKQTEELKEEIKMELVSTTKDEPEKLRLIDLIQRLGVCYHFENEINNILQQLHHITITSEKNGDDNPYNMTLCFRLLRQQGYNVSSEPFDRFRGKWESSYDNNVEELLSLYEASQLRMQGEEALDEAFCFATAQLEAIVQDPTTDPMVAAEIRQALKWPMYKNLPRLKARHHIGLYSEKPWRNESLLNFAKMDFNKLQNLHQTEIAYISKWWDDYGFAEKLSFARNRIVEGYFFALGIFFEPQLLTARLIMTKVIAIGSMLDDIYDVYGTFEELKLLTLALERWDKSETKQLPNYMKMYYEALLDVFEEIEQEMSQKETETTPYCIHHMKEATKELGRVFLVEATWCKEGYTPKVEEYLDIALISFGHKLLMVTALLGMGSHMATQQIVQWITSMPNILKASAVICRLMNDIVSHKFEQERGHVASAIECYMEQNHLSEYEALIALRKQIDDLWKDMVENYCAVITEDEVPRGVLMRVLNLTRLFNVIYKDGDGYTQSHGSTKAHIKSLLVDSVPL

SEQ ID NO: 430 - protein, 952 aa, Giberella fujikuroi
  (-)-copalyl diphosphate/(-)-ent-kaurene synthase
  ref <308>: DATABASE ACCESSION NUMBER: Uniprot Acc. No. Q9UVY5
MPGKIENGTPKDLKTGNDFVSAAKSLLDRAFKSHHSYYGLCSTSCQVYDTAWVAMIPKTRDNVKQWLFPECFHYLLKTQAADGSWGSLPTTQTAGILDTASAVLALLCHAQEPLQILDVSPDEMGLRIEHGVTSLKRQLAVWNDVEDTNHIGVEFIIPALLSMLEKELDVPSFEFPCRSILERMHGEKLGHFDLEQVYGKPSSLLHSLEAFLGKLDFDRLSHHLYHGSMMASPSSTAAYLIGATKWDDEAEDYLRHVMRNGAGHGNGGISGTFPTTHFECSWIIATLLKVGFTLKQIDGDGLRGLSTILLEALRDENGVIGFAPRTADVDDTAKALLALSLVNQPVSPDIMIKVFEGKDHFTTFGSERDPSLTSNLHVLLSLLKQSNLSQYHPQILKTTLFTCRWWWGSDHCVKDKWNLSHLYPTMLLVEAFTEVLHLIDGGELSSLFDESFKCKIGLSIFQAVLRIILTQDNDGSWRGYREQTCYAILALVQARHVCFFTHMVDRLQSCVDRGFSWLKSCSFHSQDLTWTSKTAYEVGFVAEAYKLAALQSASLEVPAATIGHSVTSAVPSSDLEKYMRLVRKTALFSPLDEWGLMASIIESSFFVPLLQAQRVEIYPRDNIKVDEDKYLSIIPFTWVGCNNRSRTFASNRWLYDMMYLSLLGYQTDEYMEAVAGPVFGDVSLLHQTIDKVIDNTMGNLARANGTVHSGNGHQHESPNIGQVEDTLTRFTNSVLNHKDVLNSSSSDQDTLRREFRTFMHAHITQIEDNSRFSKQASSDAFSSPEQSYFQWVNSTGGSHVACAYSFAFSNCLMSANLLQGKDAFPSGTQKYLISSVMRHATNMCRMYNDFGSIARDNAERNVNSIHFPEFTLCNGTSQNLDERKERLLKIATYEQGYLDRALEALERQSRDDAGDRAGSKDMRKLKIVKLFCDVTDLYDQLYVIKDLSSSMK

SEQ ID NO: 431 - protein, 554 aa, Gossypium arboreum; identical to SEQ ID NO: 406
  (+)-alpha-cadinene synthase
  ref <308>: DATABASE ACCESSION NUMBER: Genbank Acc. No. AAA93064

SEQ ID NO: 432 - protein, 584 aa, Ixeris dentate
  germacrene A synthase
  ref <308>: DATABASE ACCESSION NUMBER: Genbank Acc. No. AAL92481
MALVRNNSINGREPVLSPRSLTSPRGLTSPRPLAVQPTPEPVRPLANFPPSIWANRFISFSLDNSELEAYANAHEEPKESVRSLITDTTIDASAKLKLIYSVHRLGLSYLYPEEIDAELDQLFKKIDLHHYEQVDLYTISVQFQVFRHHGYKLSSDIFKKFKDTTTGTFTDEVTKDVKGMLSLYESAHLRLHGEEILDEALVFTEAQLKKIVSTLEGDLANQVNQVLKRPFHTGMPMVEARLYFNTHEEDVSCYESIVKLAKVHFNYLQLQQKEELRIVSQWWKDMEFQTSVPYIRDRVPEIYLWILGLYFEPYYSRARIIATKITLFLVVLDDTYDAYATIDEIRAITDAINRWEMSAIDLLPEYIKPFYRILLNEYDDLEKEYSKDGRAFSVHASKQAFQEIARGYLEEAEWLHNGYVATFPEYMKNGLITSAYNVISKSALVGMGAIADEEALAWYETHPKILKASELISRLQDDVMTFQFERKRGQSATGVDAYIKEYNVSEEVAIKDLMKMIENAWKDINEGCLKPTEVSVALLTPILNLARMIDVVYKFDDGFTFPGKTLKDYITLLFVTPAPSLESC

SEQ ID NO: 433 - protein, 799 aa, Lactuca sativa
  copalyldiphosphate synthase No. 1
  ref <308>: DATABASE ACCESSION NUMBER: Genbank Acc. No. BAB12440
MKTMISSPIPAFHPRFSPAAGSRRLSPILPSSGSVVLTGSKTQCKAVSKSPTQEYFDVLQKNGLPFINWQNDVVEDELDKEKKILYPNDEIKGFVERIKVMLGSMDEGEITVSAYDTAWVALVQDIDGNGRPEFPSSLEWIVKNQLSDGSWGDHLIFSAHDRIINTLACVIALTSWNVHPGKCQKGLKFLNDNISKLEEENPEHMPIGFEVAFPSLIDIARKLDIQVPEDSPALKEIYARRNLKLTKIPKSLMHKVPTTLLHSLEGMPDLEWEKLLKLQCKDGSFLFSPSSTAFALMQTKDQKCLQYLTDAVTKFNGGVPNVYPVDLFEHIWVVDRLQRLGISRYFDSEIKDCVDYIYRYWTKDGICWAKNSNVQDIDDTAMGFRVLRMHGYKVTTDVFRQFEKDGKFVCFPGQTTQAVTGMFNLFRASQVLFPDEKILEDAKKFSYNYLKEKQSTNELLDKWIIAKDLPGEVEYALDVPWYASLPRLETRFYLEQYGGEDDVWIGKTLYRMGNVSNNTYLEMAKLDYNNCLAIHHLEWNTMQQWYVDFGMERFGTSDITSLLVSYYLAAASVFEPERSKERIAWAKTTTLVDTISSFFHSLKISNEHRREFVEEFRNISNSIHHAKYGKPWHGLMVALKGTLHEIALDVLMTHRRDIHPQLHHAWEMWLMRWQQGVDATEGQAELIVQTINMTAGRWVSNELLAHPQYRLLSSVINNICHEIYHNRTCMEVNSTTISTSIDSKMQELVQLVLSDSLDDLDQDLKQTFLTVAKTFYYKAYCDPETINVHISKVMFETII

SEQ ID NO: 434 - protein, 559 aa, Lactuca sativa
  germacrene A synthase LTC1
  ref <308>: DATABASE ACCESSION NUMBER: Genbank Acc. No. AAM11626
MAAVEANGTLQANTKTTTEPVRPLANFPPSVWGDRFLSFSLDNTELEGYAKAMEEPKEEVRRLIVDPTMDSNKKLSLIYSVHRLGLTYLFLQEIEAQLDNIFKAFKLQDYDEVDLYTTSINFQVFRHLGHKLPCDVFNKFKDSSSGTFKESITNDVKGMLGLYECAQLRLRGESILDEASAFTVTQLKSVVNTLEGKLAQQVLQSLKRPFHQGMPMVEARFYFSNYDEECSTHESLVKLAKLHFNYLQLQQKEELRIVSKWWKDMRFQETTPYIRDRVPEIYLWILGLYFEPRYSLARIIATKITLFLVVLDDTYDAYATIEEIRLLTDAINRWDISAIEQIPEYIRPFYKILLDEYAELEKQLAKEGRAKSVIALKEAFQDIARGYLEEAEWTNSGYVASFPEYMKNGLVTSAYNVISKSALVGMGEMVSEDALAWYESHPKTLQASELISRLQDDVMTYQFERERGQSATGVDSYIKTYGVSEKEAIDELNKMIENAWKDINEGCLKPREVSMDLLAPILNLARMIDVVYRYDDGFTFPGKTMKEYITLLFVGSSPM

SEQ ID NO: 435 - protein, 557 aa, Lactuca sativa
  germacrene A synthase LTC2
  ref <308>: DATABASE ACCESSION NUMBER: Genbank Acc. No. AAM11627
MAAVDTNATIQEKTTAEPVRPLANFPPSVWGDRFLSFTLDNSELEGYAKAMEAPKEELRRLIVDQTMDSNKKLSLIYSVHRLGLTYLFLQEIEAQLDKIFKEFNLQNYDEVDLYTTSINFQVFRHLGYKLPCDVFNKFKDNTSGAFKEDISTDVKGMLGLYESSQLRTRGESILDEASSFTETKLKSVVNNLEGNLAQQVLQSLRRPFHQGMPMVEARLYFSNYSEECATHECLLKLAKLHFSYLELQQKEELRIVSKWWKDMRFQETTPYIRDRVPEIYLWILGLYFEPRYSLARIIATKITLFLVVLDDTYDAYATIEEIRLLTDAINRWDMSAMEQIPEYIRPFYKILLDEYAELEKQLAIEGRAKSVIASKEAFQDIARGYLEEAEWTNSGYVASFPEYMKNGLITSAYNVISKSALVGMGDIVSENALAWYESHPKTLQASELISRLQDDVMTYQFERERGQSATGVDAYIKTYGVSEKEAIDELKIMIENAWKDINEGCLKPREVSMDLLAPILNLARMIDVVYRYDDGFTFPGKTMKEYITLLFVGSVSM

SEQ ID NO: 436 - protein, 538 aa, Lavandula angusivolia
  (E)-alpha-bergamotene synthase
  ref <308>: DATABASE ACCESSION NUMBER: Genbank Acc. No. ABB73046
MEARRSGNFESSIWDDDYIQSLTSSYTGKMYVDKSEKLKIEVKMMMDEATDELEQLELINDLQRLGISYHFKDGIAKMLNNIYKSDSKYMEKDLHLTALKFRLLRQHGYRVPQDVFSSFMDDEGNFEAWVVEDVSVLVSLYEASHISVEGESILDMAKDFSSHHLTEMVEQIGEACLAEQVKRTLELPLHWRVGRLEARWFVQAYETRPNSNPTLVELAKLDFNMVQAKYQDELKRCSRWYEETGLPEKMSFARHRLAECFLWSLGFIPDPHHGYSREIMTKIAVLITITDDIYDIYGALEELQEFTEAFERWDINSLDLLPEYMQICFLAIFNSANELGYQILRDQGLNIIPNLKRSWAELSRAYYLEARWFHNGFVPTTDQYLNTAWISISGPLLLSYGYLTTTNPINNKELKSLEKHPSIIRWPSMVLRLADDLGTSSEEIKRGDVSKSIQCYMNETGCCEGDARHHVKSLIEVALKRMNDEILMEKPFKSFDTNAMNLARISLCFYQYGDGFGKPHSDTIKNLVSLIVLPFHMP

SEQ ID NO: 437 - protein, 548 aa, Lycopersicon esculentum
  germacrene C synthase
  ref <308>: DATABASE ACCESSION NUMBER: Genbank Acc. No. AAC39432
MAASSADKCRPLANFHPSVWGYHFLSYTHEITNQEKVEVDEYKETIRKMLVETCDNSTQKLVLIDAMQRLGVAYHFDNEIETSIQNIFDASSKQNDNDNNLYVVSLRFRLVRQQGHYMSSDVFKQFTNQDGKFKETLTNDVQGLLSLYEASHLRVRNEEILEEALTFTTTHLESIVSNLSNNNNSLKVEVGEALTQPIRMTLPRMGARKYISIYENNDAHHHLLLKFAKLDFNMLQKFHQRELSDLTRWWKDLDFANKYPYARDRLVECYFWILGVYFEPKYSRARKMMTKVLNLTSIIDDTFDAYATFDELVTFNDAIQRWDANAIDSIQPYMRPAYQALLDIYSEMEQVLSKEGKLDRVYYAKNEMKKLVRAYFKETQWLNDCDHIPKYEEQVENAIVSAGYMMISTTCLVGIEEFISHETFEWLMNESVIVRASALIARAMNDIVGHEDEQERGHVASLIECYMKDYGASKQETYIKFLKEVTNAWKDINKQFSRPTEVPMFVLERVLNLTRVADTLYKEKDTYSTAKGKLKNMINPILIESVKI

SEQ ID NO: 438 - protein, 548 aa, Lycopersicon esculentum
  beta-elemene synthase
  ref <308>: DATABASE ACCESSION NUMBER: Genbank Acc. No. AAG41889
MAASSADKCRPLANFHPSVWGYHFLSYTHEITNQEKVEVDEYKETIRKMLVETCDNSTQKLVLIDAMQRLGVAYHFDNEIETSIQNIFDASSKQNDNDNNLYVVSLRFRLVRQQGHYMSSDVFKQFTNQDGKFKETLTNDVQGLLSLYEASHLRVRNEEILEEALTFTTTHLESIVSNLSNNNNSLKVEVGEALTQPIRMTLPRMGARKYISIYENNDAHHHLLLKFAKLDFNMLQKFHQRELSDLTRWWKDLDFANKYPYARDRLVECYFWILGVYFEPKYSRARKMMTKVLNLTSIIDDTFDAYATFDELVTFNDAIQRWDANAIDSIQPYMRPAYQALLDIYSEMEQVLSKEGKLDRVYYAKNEMKKLVRAYFKETQWLNDCDHIPKYEEQVENAIVSAGYMMISTTCLVGIEEFISHETFEWLMNESVIVRASALIARAMNDIVGHEDEQERGHVASLIECYMKDYGASKQETYIKFLKEVTNAWKDINKQFFRPTEVPMFVLERVLNLTRVADTLYKEKDTYTNAKGKLKNMINSILIESVKI

SEQ ID NO: 439 - protein, 552 aa, Lycopersicon esculentum
  beta-elemene synthase
  ref <308>: DATABASE ACCESSION NUMBER: Genbank Acc. No. AAG41890
LVPNSARASADKCRPLANFHPSVWGYHFLSYTHEITNQEKVEVDEYKETIRKMLVETCDNSTQKLVLIDAMQRLGVAYHFDNEIETSIQNIFDASSKQNDNDNNLYVVSLRFRLVRQQGHYMSSDVFKQFTNQDGKFKETLTNDVQGLLSLYEASHLRVRNEEILEEALTFTTTHLESIVSNLSNNNNSLKVEVGEALTQPIRMTLPRMGARKYISIYENNDAHHHLLLKFAKLDFNMLQKFHQRELSDLTRWWKDLDFANKYPYARDRLVECYFWILGVYFEPKYSRARKMMTKVLNLTSIIDDTFDAYATFDELVTFNDAIQRWDANAIDSIQPYMRPAYQALLDIYSEMEQVLSKEGKLDRVYYAKNEMKKLVRAYFKETQWLNDCDHIPKYEEQVENAIVSAGYMMISTTCLVGIEEFISHETFEWLMNESVIVRASALIARAMNDIVGHEDEQERGHVASLIECYMKDYGASKQETYIKFLKEVTNAWKDINKQFFRPTEVPMFVLERVLNLTRVADTLYKEKDTYTNAKGKLKNMINSILIESVKI

SEQ ID NO: 440 - protein, 544 aa, Lycopersicon hirsutum
  germacrene B synthase
  ref <308>: DATABASE ACCESSION NUMBER: Genbank Acc. No. AAG41891
MAASSANKSRPLANFHPTVWGYHFLSYTHEITNQEKVEVDEYKETIRKMLVEAPEGSEQKLVLIDAMQRLGVAYHFHNEIETSIQNIFDAPKQNNNLHIVSLRFRLVRQQGHYMSSDVFKQFTNQDGKFKETLTNDVQGLLSLYEASYLRVRDEEILEEALAFTTTHLKSIVSTMSNNNNSLKVEVSEALTQPIRMTLPRMEARRYISIYENNDAHNHLLLKFAKLDFNMLQKLHQRELSDLTRWWKDLDFANKYPYARDRLVECYFWILGVYFEPKYSRARKMMTKVLKMTSIIDDTFDAYATFDELEPFNDAIQRWDANAIDSIPPYMRPAYQAFLDIYSEMEQVLSKKGKLDRVYYAKNEMKKLVRAYFKETQWLNDCDHIPKYEEHMENSLVSGGYMMIPTTCLVGMEEFISIETFEWLMNDPLIVRASSLIARAMNDIVGHEVEQERGHVASLIECYMKDYGASKQEAYAKFKKDVTNAWKDINKEFFRPTEVPMFVLERVLNLTRAAEPLYKEKDAYTNAKGKLKNMINSILIESVKI

SEQ ID NO: 441 - protein, 546 aa, Lycopersicon hirsutum
  germacrene D synthase
  ref <308>: DATABASE ACCESSION NUMBER: Genbank Acc. No. AAG41892
MAASFANKCRPLANFHPTVWGYHFLYYNPEITNQEKIEVDEYKETIRKMLVEAPEGSEQKLVLIDAMQRLGVAYHFHNEIETSIQNIFDAPKQNNDDNLHIVSLRFRLVRQQGHYMSSDVFKQFTNQDGKFKETLTNDVQGLLSLYEASHLRVRNEEILEEALTFTTTHLESIVSNLSNKNNSLKVEVSEALSQPIRMTLPRIGARKYISIYENNDAHNHLLLKFAKLDFNMLQKFHQRELSDLTRWWKDLDFANKIPYARDRLVECYFWILGVYFEPKYSRARKMMTKVLKMTSIIDDTFDAYANFDELVPFNDAIQRWDANAIDSIPPYMRPIYQALLDIYGEMDQVLSKEGKLDRVYYAKYEMKKLVRAYFKESQWLNDDNHIPKYEEHMENAIVTVGYMMGATNCLVGMEEFISKETFEWLMSEPVIVRASSLIGRAMDDIVGHEVEQERGHVASIIECYMKDYGASKQEAYAKFKKDVTNAWKDINKEFFRPTEVPMFVLERALNFTRVIDTLYQEEDEYTNAKGKLKNMIHSILIESVKI

SEQ ID NO: 442 - protein, 550 aa, Magnolia grandiflora
  beta-cubebene synthase
  ref <308>: DATABASE ACCESSION NUMBER: Genbank Acc. No. ACC66281
MDSPTTQRPNMEIGRAFVNYHPSIWGEHFIAASPDVMRLDAHKGRGEELKEVVRNMFSTVNDPLLKMNLIDAIQRLGVAYHFEMEIDKALGQMYDDHINGKDDGFDLQTLALQFRLLRQQGYNVSSGVFAKFKDDEGNFSSILSKDTHGLLSLYEAAFLGTHGDDILDEAITFTTVHLKSTLPHVSAPLTKLVELALEIPLHRRMERLQTRFYISIYEEDRERNDVLLEFSKLEFLRLQSLHQRELRDISLWWKEMDLLAKLPFTRDRVLEGYFWTVGVYFEPHYSRARMIMTKMIAFATVMDDTYDVYGTLEELELLTATIERWNRGDMDQLPDYMKVIFIALLDGVDATEDDLTGEGKSYRIYYLKEAVKDLAKAYLAEARWVSSGYVPTSEEYMKVALISAVYPMLFVAFLIGMDEVVTKEVLEWAIHMPTMLRTCSIVARLMDDIPSNKLEQERKHVSSSVECYMKEHGTSYHESIQKLREMVASGWKDINKECLKPTPVPTAVINVILNFTRVLEIIYQHRDGYTDASVETKEHIASLFVDPIPL

SEQ ID NO: 443 - protein, 576 aa, Malus x domestica
  (E,E)-alpha-farnesene synthase
  ref <308>: DATABASE ACCESSION NUMBER: Genbank Acc. No. AAO22848
MEFRVHLQADNEQKIFQNQMKPEPEASYLINQRRSANYKPNIWKNDFLDQSLISKYDGDEYRKLSEKLIEEVKIYISAETMDLVAKLELIDSVRKLGLANLFEKEIKEALDSIAAIESDNLGTRDDLYGTALHFKILRQHGYKVSQDIFGRFMDEKGTLENHHFAHLKGMLELFEASNLGFEGEDILDEAKASLTLALRDSGHICYPDSNLSRDVVHSLELPSHRRVQWFDVKWQINAYEKDICRVNATLLELAKLNFNVVQAQLQKNLREASRWWANLGIADNLKFARDRLVECFACAVGVAFEPEHSSFRICLTKVINLVLIIDDVYDIYGSEEELKHFTNAVDRWDSRETEQLPECMKMCFQVLYNTTCEIAREIEEENGWNQVLPQLTKVWADFCKALLVEAEWYNKSHIPTLEEYLRNGCISSSVSVLLVHSFFSITHEGTKEMADFLHKNEDLLYNISLIVRLNNDLGTSAAEQERGDSPSSIVCYMREVNASEETARKNIKGMIDNAWKKVNGKCFTTNQVPFLSSFMNNATNMARVAHSLYKDGDGFGDQEKGPRTHILSLLFQPLVN

SEQ ID NO: 444 - protein, 553 aa, Medicago truncatula
  (-)-cubebol synthase
  ref <308>: DATABASE ACCESSION NUMBER: Genbank Acc. No. ABB01625
MSTVAYSDHDAKQRNLADYHPSVWGGFFLQYASETMELDQNLASQIDTLKDEVRNMLVSKTEMPLTKVKLIDSICRLGVGYHFEKEIDEVLQHIHKSYVENGEITLEDSLCSLAMLFRVFRQQGLHVSPNVFNKFKDKQGNFNENLSTDVEGMLSLYEASHMMVHEDDILEEALNFTSTHLESIASQSSPSLAAQIEYTLKQALHKNIPRLEARHYISIYEKDPTCDEVLLTFAKLDFNLLQSLHQKEFGNISKWWKELDFSTKLPYARDRIAECSFWVLTAFFEPQYSQARKMMIKVITLLSIIDDTYDAYGTIDELELFTKAVERWDISSLDELPDYMKPIYRSFLTIYEEIEKEMRKEGRIYTLDYYKIEFKKSVQAFMTEARWLNENHIPTTEEYMRISKKSGAYPLLILTSYIGMGDIATKEIFNWVSNEPRIVNAAATLCRLMDEIVSSEFEQKRGHVCSLLDCYMKQFDMSREAAIQECKNRMTIVWKDINEECLRPTEVPMPFMTRVLNLSRFMDVIYKNKDNYTDSDGLMKTCIKEVLVDPVPI

SEQ ID NO: 445 - protein, 562 aa, Medicago truncatula
  (E)-beta-caryophyllene synthase
  ref <308>: DATABASE ACCESSION NUMBER: Genbank Acc. No. AAV36464
MSVSVTSSLVAPTPNANSDFSRRSANYHPNIWGDLFIQYVLEPMEFDEIMKQIIMLKEKVRQMLVPNVNVTNPSREANLIDSIQRLGLYHHFEQEIGELLRHIDNNHVENGTITLNEDLHSIALVFRLLRQQGYHILPDVFKKFKNEQGNFKETLVGDVEGMLSLYEATHMRIHGEEILDDALSFTSLHLEMMTTQLSPSVATKINHSLKRPLFKNLPRLVARHYISTYEEDPSHDATLLLLAKLDFNLLQKQHQKEVGDISKWWKDLDFATKLPFARNRIVEAYFWILGVYFEPQYSFGRRIMTKVISLASVIDDIYDVYGTIEELQLFTQAIERWDISCMDFLPQYMKFCYKAVLDVYEEMEQEMVKEGRAFCVFYAKNEMKRLVQAYFTEAKWFSRNYIPTVDEYMALGIVNSGYYLITATSFIGMGCIATEDVFQWLTNNPKIVNASSKIARLMDDIVSNEFEQERGHGASAIECYMNEHGVSREDAVNELSRQVTNAWKDTNEELLDPTEVPKPLLIRVLNLSRVIDVLYKDGDCYTNSQGSTKNDIISILLNPCPV

SEQ ID NO: 446 - protein, 573 aa, Medicago truncatula
  3S-(E)-nerolidol synthase
  ref <308>: DATABASE ACCESSION NUMBER: Genbank Acc. No. AAV36466
MAFSLSFATSTKHSTFSSNKTSNILEYNKTNLTSVFNQIHIPKSGKCKDDLHIRHAKALDEVKQVFVRNIRKNTDECLSMVDSIQRLGMEYNFEEEIEATLERKHTMLRFQNFQRNEYQGLSQAAFQFRMLRQEGYYISPDIFDKFCDNKGKLKYTFSEDINGMIALFEASQLSIEGEDCLDNVGQFCGQYLNDWSSTFHGHPQAKFVAHTLMYPTHKTLSRFTPTIMQSQNATWTNSIQQFSKIDTQMVSSSHLKEIFAVSKWWKDLGLPKDLEFARDEPIKWYSWSMACLPDPQFSEERIELTKPLSLIYIIDDIFDFYGNIDELTLFTDAVKRWDLSAIEQLPDCMKVCFKALYDITNEFALRTYIKHGWNPLTSLIKSWVRLLNAFLQEAKWFASGNVPKSEEYLKNAIVSTGVHVILVHAFFCMGQGITEKTVSLMDDFPTIISTTAKILRLCDDLEGDKDVNCEGNDGSYSKCYMKDNPGVSIGLTKEHMSEQISDAWKQLNKECLNTNPLPSSFTKLCLNAARMVPIMYNYDGNTPSKLEEYVKSLLNDGGYLQSIHSPTSEHSTV

SEQ ID NO: 447 - protein, 551 aa, Mentha x pipereta
  (Z)-muurola-3,5-diene synthase
  ref <308>: DATABASE ACCESSION NUMBER: Genbank Acc. No. CAH10288
MATNGVVISCLREVRPPMTKHAPSMWTDTFSNFSLDDKEQQKRSETIEALKQEARGMLMAATTPLQQMTLIDTLERLGLAFHFETEVEYKIEQINAAAEDDGFDLFATALRFRLLRQHQRHVSCDVFDKFVDKDGKFEESLSNNVEGLLSLYEAAHVGFREERILQEAVNFTRHHLEGAELDQSPLLIREKVKRALEHPLHRDFPIVYARLFISIYEKDDSRDELLLKLSKVNFKFMQNLYKKELSQLSRWWNTWDLKSKLPYARDRVVEAYVWGVGYHYEPQYSYVRMGLAKGILIIGIMDDTYDNYATLNEAQLFTQVLDKWDRDEADRLPEYMKIVYEFILSTCENYERDAAKLGKSFAAPYFKETVKQLARAFNQEQKWVMERQLPSFQDYVKNSEKTSCIYTMFASIIPGLKSVTQETIDWIKSEPTLATSTGMIGRYWDDIGSHLRESKGGEMLTALDFHMKEYGLTKEEAASKFEGLVEETWKDINKEFIATTNYNVGREIAITFLNYARICEASYSKTDGDAYLDPNVAKANVVALFVDAIVF

SEQ ID NO: 448 - protein, 550 aa, Mentha x pipereta
  (E)-beta-farnesene synthase
  ref <308>: DATABASE ACCESSION NUMBER: Genbank Acc. No. AAB95209
MATNGVVISCLREVRPPMTKHAPSMWTDTFSNFSLDDKEQQKCSETIEALKQEARGMLMAATTPLQQMTLIDTLERLGLSFHFETEIEYKIELINAAEDDGFDLFATALRFRLLRQHQRHVSCDVFDKFIDKDGKFEESLSNNVEGLLSLYEAAHVGFREERILQEAVNFTRHHLEGAELDQSPLLIREKVKRALEHPLHRDFPIVYARLFISIYEKDDSRDELLLKLSKVNFKFMQNLYKEELSQLSRWWNTWNLKSKLPYARDRVVEAYVWGVGYHYEPQYSYVRMGLAKGVLICGIMDDTYDNYATLNEAQLFTQVLDKWDRDEAERLPEYMKIVYRFILSIYENYERDAAKLGKSFAAPYFKETVKQLARAFNEEQKWVMERQLPSFQDYVKNSEKTSCIYTMFASIIPGLKSVTQETIDWIKSEPTLATSTAMIGRYWNDTSSQLRESKGGEMLTALDFHMKEYGLTKEEAASKFEGLVEETWKDINKEFIATTNYNVGREIAITFLNYARICEASYSKTDGDAYSDPNVAKANVVALFVDAIVF

SEQ ID NO: 449 - protein, 547 aa, Mikania micrantha
  beta-caryophyllene synthase
  ref <308>: DATABASE ACCESSION NUMBER: Genbank Acc. No. ACN67535
MGCKQESFRPFRSTSPSVWGDMFLNYEKKAEQCDVELTVEDLKEKVREAITGALGNPKEHVNLLKLIDAIQRLGIPYYFEDEITNALQHLYEAYGDEWVGGSPSIWFRLLRQHGFYVSCDIFNKYYKDKHGDFKESLINDDEEMVELYEATSLRVRGEVVLDEAFEFTRNHFANIAKEPRCSNATLSTHIQVALETPLHKRIPRLDALRYIRFYEKQASHNESLLKLAKLGFNLLQSLHRSELSQVSKWWKDVDVQKNLPYARDRMVESYFWAIGVYSEPKYSLGRVFLAKVIQLATAIDDTFDAYGTYEELQTFTRAVERWSITCLDELPEYMKLLYQVLLDLYGEMEPIMEKEQLTPLFNCSKEFMIETVKAYMVEAKWVYEGHIPTKDEHTSIAFATGGGPLLMSSCYLGMGDIITNDSINWVISEPPLLKATNMIGRLLNDIVSSKKEQERVHFQSIVQCYKKQYDVSEEHAINLVREEIEDVWKDINKDSLTAKDVPRPLILVVVNYARTLYYLYKYNDNFFEVEEDIKEDIKSLLIHPMSI

SEQ ID NO: 450 - protein, 548 aa, Nicotiana attenuata
  5-epi-aristolochene synthase
  ref <308>: DATABASE ACCESSION NUMBER: Genbank Acc. No. AAO85555
MASAAVGNYEEEIVRPVADFSPSLWGDHFLSFSIDNHVAQKYAQEIEPLKEQTRSMLVATGRKLVDTLNLIDTIERLGISYHFEKEIDEILDQIYNQNSNSSDLFTSALLFRLLRQHGFNISPEIFSKFQDENGKFKESLASDVVGLLNLYEASHVRTHADDILEAALAFSTIHLESAAPHLKSPLREQVAHALEQCLHKGVPRVETRFFISSIYEKEQSKNNVLLRFAILDFNLLQMLHKQELAEVSRWWKDLDFVTTLPYARDRVVECYFWALGVYFEPQYSQARVMLVKTISMISIVDDTFDAYGTVKELETYTDAIQRWDINEIDRLPDYMKISYKAILDLYKDYEKELSSAGRSHIVCHAIERMKEVVRNYNVESTWFIEGYMPPVSEYLSNALATTTYYYLATTSYLGMKSATEQDFEWLSKNPKILEASVIICRVIDDTATYEVEKSRGQIATGIECCMRDYGVSTKEAMDKFQQMAETAWKDLNEGLLRPTPVSAELLTPILNLARIVEVTYIHNLDGYTHPEKVLKPHIIGLLVDSIDI

SEQ ID NO: 451 - protein, 546 aa, Ocimum basilicum
  germacrene D synthase
  ref <308>: DATABASE ACCESSION NUMBER: Genbank Acc. No. AAV63786
MTNMFASAAPISTNNTTVEDMRRSVTYHPSVWKDHFLDYASGITEVEMEQLQKQKERIKTLLAQTLDDFVLKIELIDAIQRLGVGYHFEKEINHSLRQIYDTFQISSKDNDIRVVALRFRLLRQHGYPVPSDVFKKFIDNQGRLDESVMNNVEGMLSLYEASNYGMEGEDILDKALEISTSHLEPLASRSRRINEALEMPISKTLVRLGARKFISIYEEDESRDEDLLKFAKLDFNILQKIHQEELTHIARWWKELDLGNKLPFARDRVVECYFWILGVYFEPQYNIARRFMTKVIAMTSIIDDIYDVHGTLEELQRFTDAIRSWDIRAIDELPPYMRLCYEALLGMYAEMENEMVKQNQSYRIEYARQEMIKLVTTYMEEAKWCYSKYIPNMDEYMKLALVSGAYMMLATTSLVGILGDPITKQDFDWITNEPPILRAASVICRLMDDVVGHGIEQKISSVDCYMKENGCSKMEAVGEFSKRVKKAWKNLNEEWVEPRAASMVILVRVVNLARVINLLYVGEDSYGNSSVKTKELIKGVLVHPIK

SEQ ID NO: 452 - protein, 541 aa, Ocimum basilicum
  alpha-zingiberene synthase
  ref <308>: DATABASE ACCESSION NUMBER: Genbank Acc. No. AAV63788
MESRRSANYQASIWDDNFIQSLASPYAGEKYAEKAEKLKTEVKTMIDQTRDELKQLELIDNLQRLGICHHFQDLTKKILQKIYGEERNGDHQHYKEKGLHFTALRFRILRQDGYHVPQDVFSSFMNKAGDFEESLSKDTKGLVSLYEASYLSMEGETILDMAKDFSSHHLHKMVEDATDKRVANQIIHSLEMPLHRRVQKLEAIWFIQFYECGSDANPTLVELAKLDFNMVQATYQEELKRLSRWYEETGLQEKLSFARHRLAEAFLWSMGIIPEGHFGYGRMHLMKIGAYITLLDDIYDVYGTLEELQVLTEIIERWDINLLDQLPEYMQIFFLYMFNSTNELAYEILRDQGINVISNLKGLWVELSQCYFKEATWFHNGYTPTTEEYLNVACISASGPVILFSGYFTTTNPINKHELQSLERHAHSLSMILRLADDLGTSSDEMKRGDVPKAIQCFMNDTGCCEEEARQHVKRLIDAEWKKMNKDILMEKPFKNFCPTAMNLGRISMSFYEHGDGYGGPHSDTKKKMVSLFVQPMNITI

SEQ ID NO: 453 - protein, 550 aa, Ocimum basilicum
  beta-selinene synthase
  ref <308>: DATABASE ACCESSION NUMBER: Genbank Acc. No. AAV63785
MSANCVSAAPTSPKNSDVEEIRKSATYHSSVWGNHFLSYTSDVTEITAAEKEQLEKLKEKVKNLLAQTPDESTGKMELIDAIQRLGVGYHFTTEIQESLRQIHEGQIRNDDDDVRVVALRFRLLRQGGYRAPCDVFEKFMDDGGNFKESLKKDVEGMLSLYEASYYGIDGEEIMDKALEFSSSHLESMLHNISTKTNKSLLRRLQEALDTPISKAAIRLGATKFISTYREDESHNEDILNFAKLDFNILQKMHQEEANYLTRWWEDLDLASKLDFARDRMVESYFWSLGVYFQPQYRTSRIYLTKIISIVAVIDDIYDVYGSFDDLRSFTDVIQSWKISNADELPPYMRICFEALLGIYEDMGDRIGAPYAIDTMKELVDTYMQEAEWCYTEYVPTVDEYMKVALVTGGYLMVATTFLTGINNITKKDFDWIRNRPRLLQVAEVLTRLMDDIAGHGTEKKTTAVSCYMKEYECSEMEASRELSKQVKKAWKDLNDEWMEPRSSSAEIIGCIVNMSRVLHIMYSTGDDGFSDSSTRTTQAVKTLLVDHPMN

SEQ ID NO: 454 - protein, 540 aa, Ocimum basilicum
  delta-cadinene synthase
  ref <308>: DATABASE ACCESSION NUMBER: Uniprot Acc. No. Q5SBP5
MDVSILRDVRPPVTSYAPNIWADTFSNISLDEEVQKKYAETIEALKQVVRGMLMAAATPIKQMIFIDTLERLGLAYHFETEIEHKLQKIYDDNVCGDDCDLFTTALRFRLLRQHRHHVSCDVFDKFLYEEGKFKGDAEGLLSLYEASHVRFHNEKILEEAERFTRQELSCWIKLQSPLKDKVKRALERPLHREVPILYARHFISIYEKDESMDEHLLKLAKFNFNFLQNLYKKELYDLSRWWNKFDLKTKLPYIRDRLAEAYLWGVGYHFEPQYSYVRKGVVLSIKIIGILDDTYDNYATVNEAQLFTEILDRWSMDEIDRLPDYMKIVLHFVMSAYEEYERDAKIVYGKKFASPYFKETIQQLARGYNQELKWVMEKQMPPFKDYLKNSEITSCIYIMFASIIPGLKSFTQEAIDWIKNEPNFAVKAGLIGRYWDDIGSHKRESKGGEMLTVMDCYMKQYSVSIQETISEFAKAVEDSWKEVNEGWVYTISMSKEITVQFLNYSRMCDASYNRNNGDGYTDPSFAKSNITALFVDPIII

SEQ ID NO: 455 - protein, 576 aa, Oryza sativa
  (E)-beta-caryophyllene synthase
  ref <308>: DATABASE ACCESSION NUMBER: Genbank Acc. No. ACF05531
MATSVPSVLLLPVPTCTDMLVSPVEGGDLLHCKPHFDHHPNVWGDYFLTFSPCTPSMLLNMKRKAHVSEEQVRRMILECSSGPNLHVKLELVDTLERLCIDYHYEKEIENVLRRVHEEEDDTDNHYDLHTTALRFYLLRKHGYYASPDVFQRFRDEEGNFTRDDNNNGTRSMLSLYNAAHLRIHGEEILDDAIVFTRNYLQSVVKHLQSPMADEVCSALRTPLFRRPRRVEARHYISVYDKLPTRNETILEFAKLDFGILQSLYCEELNILTMWWKELQLQDHLSFARDRMVEMHFWMLGVLFEPQYSYGRTMLTKLFIFVSIFDDIYDNYSTLEESKLFTEAIERWDEEAAEELPGYMKFFYKKVLTTMKSIETDLKLQGNKHVDYVKNLLIDATRCFYNEVKWRSEGADQVAATVEEHLKISVPSSCCMHVPVYAFVAMGNDVTTDDAINWGMAYPKIITSSCIVGRLLNDIASHEREQGSSSSSSSTVEACMREHGGITKEEAYAKLRELVEESWMDIAGECLRPAAAQPPPLLEAVVNATRVLDFVYKDDQDAYTHPSSLKDTIHSIYILSV

SEQ ID NO: 456 - protein, 576 aa, Oryza sativa; identical to SEQ ID NO: 455
  (E)-beta-caryophyllene synthase
  ref <308>: DATABASE ACCESSION NUMBER: Genbank Acc. No. ABJ16553

SEQ ID NO: 457 - protein, 540 aa, Oryza sativa
  (E,E)-farnesol synthase
  ref <308>: DATABASE ACCESSION NUMBER: Genbank Acc. No. ABJ16554
MAPAFHPAIFGDFFINNVQPSPKESDEWMEERVDQLVEEVGRMLEVCKDDVVKQMNLVDVLQRLGIDHHFEEQIDTILKNIHRAEFNSSDLYEVALRFRLLRKQGYWVSPDEFNKFKAEDGSFSSDDITNDPKGLLSLYNAAHLLTHNEKALEEAILFARHHLQLLRGNLAYPLDEQVTRALEIPLPRTMKRVEVLNYIFEYSAEEKMFNPSILELAVLDFNILQKVHQNELKEICQWWENLSSDIRLDYVRERVVECYFCAYAAYYEKEHARARMIFAKRCMLFSLLDDTYDVRATLEEARKFNDALQRWDKSDVSLLPEDLKRFFLSIISNFREFEDELEPHEKYRNSYNIKAFQILSSNFLQEAEWFHQNYIPCFTDHVTVSLQTGGAIELPVSLIVGMGDIATKEVLDWALANPDAGRAFAEVARFMDDLAASHSGRDKMDVASTVECYMNEHGVTREVAEAKIAGMAEDGWKSMNQIRFKHRAFLPFVQRIANLCMSATLLYHGKKNGFSNSLELKDMFESHFVNPIPLNHIDYD

SEQ ID NO: 458 - protein, 546 aa, Oryza sativa
  alpha-zingiberene synthase
  ref <308>: DATABASE ACCESSION NUMBER: Genbank Acc. No. ACF05529
MSSTPAANFSNEDDERKAPTGFHPSLWGDFFISYQPPTAPKHAYMKERAEVLKEEVRKVVKGSNEVPEILDLVITLQRLGLDSYYKAEIDELLCTVYNTDYNDKDLHLVSLRFYLLRKNGYDVSSDIFQHFKDKEGSFVADDTRSLLSLYNAAYMRTHGEKVLDEAVVFTTNRLRSELKHLKSPVADEVSLALDTPLFRRVRIIETQNYIPIYESATTRNEAILEFAKLNVNLLQLIYCEELKTITRWWKELNVESNLSFIRDRIVEMHFWMTGACSEPHYSLLRIILTKMTAFITILDDIFDTYATTEESMMLAKAIYMCNESATVLLPKYMKDFYLYYLKTFDSFEEALGPNKSYRVLYFKELFKILIKGYSEEIKWRDDHYIPKTIEEHLELSRMTVGAFQLACASLVGMGDFITEDTLDYLLTYPKLIKSYTTCVRLSNDIASTKREQAGDHYASTIQCYMLQHGTTIHEACIGIKELIEDSWKDMMKEYLAPTNLQPKIVARTVIDFARTGDYIYKQADSFTFSHTIKDMIASLYVEPYSI

SEQ ID NO: 459 - protein, 550 aa, Perilla frutescens var. frutescens
  sesquiterpene synthase
  ref <308>: DATABASE ACCESSION NUMBER: Genbank Acc. No. AAX16076
MASEQAQNHRPVADFSPSLWGDQFIKHDSCPQVEKKYSNTVDVLKKEVKGMITAPGTKMVDTMELIDTIERLGVSYHFQDEIEHKLQQFFDLKPDYCNDDDDAYDLHTVALHFRLFRQHGYRISCDIFGRWVHGDGKFEEILKSDGKGLLSLYEASYLRTRGETILDEALDFATASLKSIAPCLESPLGKQVVHALVQPLHFGTPRIEARNFISIYEEYEGRNESLLMFAKIDYNLLQMLHKEELHQVSRWWKELDLIAKLPYARDRVVECFFWAIGAYHEPQYSRARVMLTKTIAMTSIIDDTYDAYGTIKELDIFTEAIERWNVKETKRLPEYMKPLYKALLELYQQFEQELENEGRSYVAYYAIESLKELVRSYRVEAKWFIQGYLPPFEEYLKNALITCSYCYHTMTSFLGVESAIKEDFEWLSNKPKMLVAGLLICRLVDDIATYEVEKARGQVATGIESYMKDNGATKEEAMAKFFEIARDAWKDINEECLRPNLYNSRDVWMRILNLERIIHVAYKDSQDGYTQPEKVLKPHIIALFVDPIQI

SEQ ID NO: 460 - protein, 550 aa, Perilla frutescens var. frutescens
  valencene synthase
  ref <308>: DATABASE ACCESSION NUMBER: Genbank Acc. No. AAX16077
MASEQAQNHRPVADFSPSLWGDQFVKYDSCPQVQKKYSNTVDVLKKEVKGMITAPGTKMVDTMELIDTIERLGVSFHFQDEIEQKLQQFFDLKTDYCNDGDDAYDLYTVALHFRLFRQHGYRISCDIFGRWIDGNGKFKEGLKSDGKSLLSLYEASYLRTRGETILDEALDFAAASLKSIAPHLQSPLGKQVVHALVQPLHFGNPRIEARNFISIYEEYEGMNEALLRLAKLDYNLLQMLHKEELHQVSRWWKDLDLITKLPYARDRVVECFFWAVGVYHEPQYSRARVMLTKTIVMTSIIDDTYDAYGTIEELDIFTEAIERWNVEETKRLPEYMKPLYKALLELYKQFEQELEKEGRSYVAYYAIESLKELVRSYRIEAKWFIQGYLPPYEEYLKNALITCTYCYHTTTSLLGVESAIKENFEWLSNKPKMLVAGLLICRLIDDIATYILERGRGQVATGIESYMKDNGATQEEPIAKIFEIATDAWKDINDECLRPSLYNSRDVLMRIFNLERIIDVTYKGNQDRYTQPEKVLKPHIIVFFFDPILI

SEQ ID NO: 461 - protein, 807 aa, Picea abies
  (E)-alpha-bisabolene synthase
  ref <308>: DATABASE ACCESSION NUMBER: Genbank Acc. No. AAS47689
MTSVSVESGTVSCLSSNNLIRRTANPHPNIWGYDFVHSLKSPYTHDSSYRERAETLISEIKVMLGGGELMMTPSAYDTAWVARVPSIDGSACPQFPQTVEWILKNQLKDGSWGTESHFLLSDRLLATLSCVLALLKWKVADVQVEQGIEFIKRNLQAIKDERDQDSLVTDFEIIFPSLLKEAQSLNLGLPYDLPYIRLLQTKRQERLANLSMDKIHGGTLLSSLEGIQDIVEWETIMDVQSQDGSFLSSPASTACVFMHTGDMKCLDFLNNVLTKFGSSVPCLYPVDLLERLLIVDNVERLGIDRHFEKEIKEALDYVYRHWNDRGIGWGRLSPIADLETTALGFRLLRLHRYNVSPVVLDNFKDADGEFFCSTGQFNKDVASMLSLYRASQLAFPEESILDEAKSFSTQYLREALEKSETFSSWNHRQSLSEEIKYALKTSWHASVPRVEAKRYCQVYRQDYAHLAKSVYKLPKVNNEKILELAKLDFNIIQSIHQKEMKNVTSWFRDSGLPLFTFARERPLEFYFLIAGGTYEPQYAKCRFLFTKVACLQTVLDDMYDTYGTPSELKLFTEAVRRWDLSFTENLPDYMKLCYKIYYDIVHEVAWEVEKEQGRELVSFFRKGWEDYLLGYYEEAEWLAAEYVPTLDEYIKNGITSIGQRILLLSGVLIMEGQLLSQEALEKVDYPGRRVLTELNSLISRLADDTKTYKAEKARGELASSIECYMKDHPGCQEEEALNHIYGILEPAVKELTREFLKADHVPFPCKKMLFDETRVTMVIFKDGDGFGISKLEVKDHIKECLIEPLPL

SEQ ID NO: 462 - protein, 580 aa, Picea abies
  (E,E)-alpha-farnesene synthase
  ref <308>: DATABASE ACCESSION NUMBER: Genbank Acc. No. AAS47697
MDLAVEIAMDLAVDDVERRVGDYHSNLWDDDFIQSLSTPYGASSYRERAERLVGEVKEMFTSISIEDGELTSDLLQRLWMVDNVERLGISRHFENEIKAAIDYVYSYWSDKGIVRGRDSAVPDLNSIALGFRTLRLHGYTVSSDVFKVFQDRKGEFACSAIPTEGDIKGVLNLLRASYIAFPGEKVMEKAQTFAATYLKEALQKIQVSSLSREIEYVLEYGWLTNFPRLEARNYIDVFGEEICPYFKKPCIMVDKLLELAKLEFNLFHSLQQTELKHVSRWWKDSGFSQLTFTRHRHVEFYTLASCIAIEPKHSAFRLGFAKVCYLGIVLDDIYDTFGKMKELELFTAAIKRWDPSTTECLPEYMKGVYMAFYNCVNELALQAEKTQGRDMLNYARKAWEALFDAFLEEAKWISSGYLPTFEEYLENGKVSFGYRAATLQPILTLDIPLPLHILQQIDFPSRFNDLASSILRLRGDICGYQAERSRGEEASSISCYMKDNPGSTEEDALSHINAMISDNINELNWELLKPNSNVPISSKKHAFDILRAFYHLYKYRDGFSIAKIETKNLVMRTVLEPVPM

SEQ ID NO: 463 - protein, 578 aa, Picea abies
  longifolene synthase
  ref <308>: DATABASE ACCESSION NUMBER: Genbank Acc. No. AAS47695
MAQISKCSSLSAELNESSIISHHHGNLWDDDFIQSLKSSNGAPQYHERAAKLVEEIKNLVVSEMKDCNDDLIRRLQMVDIFECLGIDRHFQHEIQVALDYVYRYWNQLEGIGIGSRDSLIKDFNATALGFRALRLHRYNVSSDVLENFKNENGQFFCSSTVEEKEVRCMLTLFRASEISFPGEKVMDEAKAFTTEYLTKVLTGVDVTDVNQSLLREVKYALEFPWHCSLPRWEARSFIEICGQNDSWLKSIMNKRVLELAKLDFNILQWAHHRELQLLSSWWSQSDIAQQNFYRKRHVEFYLWVVIGTFEPEFSTCRITFAKISTLMTILDDLYDTHGTLEQLKIFTEGVKRWDLSLVDRLPDYIKITFEFFLNTSNELIAEVAKTQERDMSAYIRKTWERYLEAYLQEAEWIAARHVPTFDEYMKNGISSSGMCILNLYSLLLMGQLLPDDVLEQIHSPSKIHELVELTARLVDDSKDFETKKVGGELASGIECYVKDNPECTLEDASNHLNGLLDLTVKELNWEFVRHDSVALCFKKFAFNVARGLRLIYKYRDGFDVSNQEMKTHIFKILIDPLT

SEQ ID NO: 464 - protein, 574 aa, Pinus taeda
  (E,E)-alpha-farnesene synthase
  ref <308>: DATABASE ACCESSION NUMBER: Genbank Acc. No. AAO61266
MSSLAVDDAERRVGDYHPNLWDDALIQSLSTPYGASPYRDVAEKLIGEIKEMFASISIEDGDDEICYFLQRLWMIDNVERLGISRHFENEIKAAMEDVYSRHWSDKGIACGRHSVVADLNSTALAFRTLRLHGYSVCSDVFKIFQDQKGEFACSADQTEGEIKGILNLLRASLIAFPGERILQEAEIFATTYLKEALPKIQGSRLSQEIEYVLEYGWLTDLPRLETRNYIEVLAEEITPYFKKPCMAVEKLLKLAKIEFNLFHSLQQTELKHLSRWWKDSGFAQLTFTRHRHVEFYTLASCIAMEPKHSAFRLGFAKLCYLGIVLDDIYDTYGKMEELELFTAAIKRWDTSTTECLPEYMKGVYMAFYDCVNEMARQAEKTQGWDTLDYARKTWEALIDAFMEEAKWISSGYVPTFQKYLDNGKVSFGYRAATLQPILTLDIPLPLHILQEIDFPSSFNDLASSILRLRGDICGYQAERSRGEQASSISCYMKDNPGSTEEDALSHVNAMIGDKIPEFNWEFMKPSKAPISSKKYAFDILRAFYHLYKYRDGFSIAKIETKKLVMRTVLDPVPM

SEQ ID NO: 465 - protein, 801 aa, Pisum sativum
  ent-kaurene synthase A
  ref <308>: DATABASE ACCESSION NUMBER: Genbank Acc. No. AAB58822
MFTHFSTHFHLPSSSSLFFLHPFYKSSSLGAVSFVAKDKEKRCRAISKSRTQEYEGVFQTNVATLKLSEINVEDVIVIDDEEEQDIRVGLVNKIKSILSSLEDGEITISAYDTAWVALVEDVNAISTPQFPSSLEWIAKNQLQDGSWGDSRLFSAHDRIINTLACVIALRSWNMHSEKCDKGMIFFRENLSKLENENEEHMPIGFEVAFPSLLEGARGIKPLMCPNDSPILKNIFEKRDEKLTRIPKEIMHKVPTTLLHSLEGMSGLDWKQLLKLQSQDGSFLFSPSSTAFALMQTKDGNCLKYLNNVVKKFNGGVPNVYPVDLFEHIWVVDRLERLGISRFFRHEIKDCMNYVSKIWSEKGICWARNSNVQDIDDTAMAFRLLRLHGHQVSAHVFKHFERNGEFFCFAGQCTQAVTGMYNLFRASQVLFPGEKILEHAKHFSAKVLKEKREANELIDKWIIMKNLPEEVGYALDMPWYANLDRIETRFYIDQYGAESDVWIGKTLYRMAYVNNNNYLELAKLDYNNCQAQHLIEWNVIQTWYLESRLGEFGLSKRDLLLAYFLATGSIFEPERSHERLAWAKTTALLETIKCYVRNEDLRKDFAKKFNDHIDVRDYSIARRMKRNKTEHELVESLFATIGEISWDVRLSYGHEIGYDMHQCWKKWLSSWQSEGDKCEGEAELLIQIINLCSNHWISEGPSMQSTIQHLLQLTNSICHKLSCYQKDKELKGISCQENITNSEVESKMQELVQMVFQKCPNDIDFNVKNTFFTIAKSFYYAAFCDSRTINFHIAKVLFEKVV

SEQ ID NO: 466 - protein, 545 aa, Pogostemon cablin
  (-)-germacrene D synthase
  ref <308>: DATABASE ACCESSION NUMBER: Genbank Acc. No. AAS86322
MDLNEITSSSRPLANYHPNVWGDRFLLHEPEFTCQAGEKQLVEELKEEVRRELKEASNDYLRQLKMVDAIQRLGIEYLFEEEIDEALRNLLAKFENYCKDNHDMYATALSFRLLRQHGYKVSCEVFDKFKDGEDGFKVEEVMAVLELFEATHMRIHGEDVLDQAFVFTRNYLQSIHATLSNPIAKQVHNALNGYSCRRGMPRIEARKYIPIYEEYGCHHKALLKLAKLDFNLLQSMHKRELTQLYRWWKDLEMPTKLPYIRDRLVETYFWDMGFYFEPQYALARNILVKVQCLVSIFDDTFDAYGAFKELQLFKDAIDRWSISCLDELPEYMQIIYKLVLDVFEEIESHMIKQGTSYRLDYAREAIKIVIGGYFDEAKWREEEYKPRMEEYMKVATKSAAYLTLIIVSFVGMKNDIATPQAFQWVLSEPQIITASLALARLSNDLVGIEFEKERKYIATAVELYEEEHKVSKEEAVLELRHETESAWKEINEALLEPTTFATPILDRILNSARVLEVFYDKTDRYTHVDLELQNIIAQLYIHPIP

SEQ ID NO: 467 - protein, 554 aa, Pogostemon cablin
  (-)-germacrene A synthase
  ref <308>: DATABASE ACCESSION NUMBER: Genbank Acc. No. AAS86320
MELKNQSVAIISSNASRPLAHYHPDVWGDRFLLYKPNPSSEAGQKPVIEELKQQVRSELKEASNDYMRQLKMVDAIQRLGIESLFEEDIDNALKNLSENFDDYCKDKHDLYAIALSFRLLRQHGYRISCDVFDKLKDGEDGFKVPPSDEALAVVELLEATHLRIHGEVVLDRAFVFARIHLESIEANLNNPVAKQVHNALYGYSNRRGMQQVEARKYIPIYEQYASHHQGLLKLATLNFNLQQTMHKRELSELSRWYRDLEVPTMLPFARQRLVETYFWDAGVVFEPENDVARMILVKVQCLISFLDDTFDAYGSFEELQLFTDAINTWDVSCLDQLPDYMKIIYKALLGVFEVIEKLMIKQGTLYRLNYAKEAMKIVVGGYFVEAKWREEKSKPTTQEYMQVATKSAGYMTLIITSFLGMEANIATKEAFDWVLSEPDVMKAAITLARLTNDIVGIELEKERKHIATAVEVYEDEHKLSMQEAMVEIKNQIESGWKTINEAFLRPTKFPTPILYRILNYCRVLEVIYDKSDRYTHVDPALQDIIKQLYIHPIP

SEQ ID NO: 468 - protein, 554 aa, Pogostemon cablin
  (-)-germacrene A synthase
  ref <308>: DATABASE ACCESSION NUMBER: Genbank Acc. No. AAS86321
MAVQISETVRPFANFSPNPSLWGDQFINHKSKTQQISRIYLEEIEGLKNEVKCMLTSTPEGKMADTVNLIDTLERLGVSYHFEKEIEEKMKHLFNLIKADNYKDHEGCDLYTDALHFRLFRQHGYPISSGIFNKWMDGNGKFKESIKSDAKGLLSLYEACCLRTHGDTLLDEALVFATASLKSMAANLASPLRKQVEHALFQHLHFGIPRVEARHFITFYEEEEHKNEMLLRFAKLDFNALQALHKEELSEISKWWKDLDLISKLPYARDRVVESYFWAVGVYYQPKYSRARIMLTKTIAMTAILDDTYDSYGTLEELDVLTKAIERWDIKEINGLPEYIKGFYKQVLKLYQQLEEELAKEGRSYAVYYAIEACKELARSYAVEAKWFKKGYLPGFEEYLINSLVTSTAGYLNIISFFGVESVTKEDFEWFSKKPRIAVATQIITRVIDDIATYEVEKEKGQSATGIDCYMKEHGVSKEKAMQRFYEMSTNAWKDINEEGLSWPSSFSRDIFVQLRNFSRMVDVTYGKNEDGYSKPEKILKPLIIALFVDQIKL

SEQ ID NO: 469 - protein, 552 aa, Pogostemon cablin
  patchoulol synthase
  ref <308>: DATABASE ACCESSION NUMBER: Genbank Acc. No. AAS86323
MELYAQSVGVGAASRPLANFHPCVWGDKFIVYNPQSCQAGEREEAEELKVELKRELKEASDNYMRQLKMVDAIQRLGIDYLFVEDVDEALKNLFEMFDAFCKNNHDMHATALSFRLLRQHGYRVSCEVFEKFKDGKDGFKVPNEDGAVAVLEFFEATHLRVHGEDVLDNAFDFTRNYLESVYATLNDPTAKQVHNALNEFSFRRGLPRVEARKYISIYEQYASHHKGLLKLAKLDFNLVQALHRRELSEDSRWWKTLQVPTKLSFVRDRLVESYFWASGSYFEPNYSVARMILAKGLAVLSLMDDVYDAYGTFEELQMFTDAIERWDASCLDKLPDYMKIVYKALLDVFEEVDEELIKLGAPYRAYYGKEAMKYAARAYMEEAQWREQKHKPTTKEYMKLATKTCGYITLIILSCLGVEEGIVTKEAFDWVFSRPPFIEATLIIARLVNDITGHEFEKKREHVRTAVECYMEEHKVGKQEVVSEFYNQMESAWKDINEGFLRPVEFPIPLLYLILNSVRTLEVIYKEGDSYTHVGPAMQNIIKQLYLHPVPY

SEQ ID NO: 470 - protein, 545 aa, Pogostemon cablin
  gamma-curcumene synthase
  ref <308>: DATABASE ACCESSION NUMBER: Genbank Acc. No. AAS86319
MAAFTANAVDMRPPVITIHPRSKDIFSQFSLDDKLQKQYAQGIEALKEEARSMLMAAKSAKVMILIDTLERLGLGYHFEKEIEEKLEAIYKKEDGDDYDLFTTALRFRLLRQHQRRVPCSVFDKFMNKEGKFEEEPLISDVEGLLSLYDAAYLQIHGEHILQEALIFTTHHLTRIEPQLDDHSPLKLKLNRALEFPFYREIPIIYAHFYISVYERDDSRDEVLLKMAKLSYNFLQNLYKKELSQLSRWWNKLELIPNLPYIRDSVAGAYLWAVALYFEPQYSDVRMAIAKLIQIAAAVDDTYDNYATIREAQLLTEALERLNVHEIDTLPDYMKIVYRFVMSWSEDFERDATIKEQMLATPYFKAEMKKLGRAYNQELKWVMERQLPSFEEYMKNSEITSGVYIMFTVISPYLNSATQKNIDWLLSQPRLASSTAIVMRCCNDLGSNQRESKGGEVMTSLDCYMKQHGASKQETISKFKLIIEDEWKNLNEEWAATTCLPKVMVEIFRNYARIAGFCYKNNGDAYTSPKIVQQCFDALFVNPLRI

SEQ ID NO: 471 - protein, 561 aa, Populus balsamifera
  ssp. trichocarpa x Populus deltoides (-)-germacrene D synthase
  ref <308>: DATABASE ACCESSION NUMBER: Genbank Acc. No. AAR99061
MSVEGSAIFSTATVEPNVSRRSAGYSPSIWGDHFLSYATDSMETSDKAEHKKLKEEVKRELMANINKPSQTLDFIDAIQRLGISYHFEIEIDEILREMYKSHCDFDNGDDDDHHHNDLYAISLKFRLLRQQGYKISCDVFGKFKNSQGTFNDSLANDTRGILSLYEATHLRVHGDEVLEEALVFTTSHLEFLATHSSSPLRAKINHALKQPVRKNIPRLEARHYFSIYQEDPSCSEVLLNFAKLDFNILQKQHQKELSEIANWWKELDFAKKLPFARDRVIECYFWILGVYLEPEYFLARRILTKVIAMTSVIDDIYDVYGTPEELELFTDAIERWEITAVDQLPEYMKVTYKALLDVYTEIEENMVTEERSYRVYYAKEAMKNLVRAYYLESKWFHQKHTPTMEEYMAVALVTSGYAMLAATSFVGMGHVVTKDSFDWLFRGPKILKASEIICRLMDDIVSHKFEQKRGHVASSIECYMKQHGTTEQETVHEFRKQVTDAWKDLNEEFLHPTAVPMPLLTRMLNLARVIDVVYKDEDGYTNAGTVLKDLVSALLIDPVPM

SEQ ID NO: 472 - protein, 826 aa, Pseudotsuga menziesii
  (E)-beta-farnesene synthase
  ref <308>: DATABASE ACCESSION NUMBER: Genbank Acc. No. AAX07265
MSLEEFYPMATVYVPSSTLPCALSTSSSSSSLVRRTANPHPNVWDYHFVQSLQSPYTDPCYGERVETLVAEIKAMLHGEGGLMITPSAYDTAWVARVPSIDGSARPQFPQTVQWILKNQLKDGSWGTESHFLLSDRLLATLSCVLALLKWKVGDLQVQQGIEFIKSNLEAIKDENDEDSLVTDFDIIFPSLLREAQYLDIELPLQPALCKSTPPKRQERLANMSREEIHGVPSPLLYSLEGIEDMVDWERIMDVRSQDGSFLSSPASIACVFMHTGDIKCLEFLNNVLTNFGTFVPCLYPVDLLERLLIVDNLVQLGIDRHFEKEIKEALDYVHRHWNERGIGWGRLNPIADLEITALGFRLLRLHRYNVSPAVFENFKDSNGHFVCSGAQFNKDVASMLSLYRASQLAFPGENILDEAKSFTSKYLKEALEKRETYSAWNNKQSLSEEIKYALENSWHASVPRVEAKRYCQVYRSDYTYLAKSVYKLPKVNNEKILELAKLDFQHYPGHPPKRDEECHHLVKNSEFPLLPFGRERPVECFFIVAAGTYEPQYAKCRFLFSKVACLNTVLDDMYDTYGTLDELKLFTEAVRRWDLSLTENLPDYMKLCYKIFYDIVHEVVLEAEKEQGRELLTFFRKGWEEYLMGYYEEAEWLACEYLPSLEEYIRNGIISIGQRILVVSGVLLMEGQILSQEALEQLDYPGRRVLTELNSIITRLADDIHTYKAEKARGELASSIECYMREHPGSTEEVAVNYMYSLLEPAVKELTWEFLKPEDSTVHIPFQCKKMLMEETRVTMVIFKEGDGFGISKTKIKDYIKDCLIEPLPL

SEQ ID NO: 473 - protein, 815 aa, Pseudotsuga menziesii
  (E)-gamma-bisabolene synthase
  ref <308>: DATABASE ACCESSION NUMBER: Genbank Acc. No. AAX07266
MAASTLPSGLSTNDLIRRTANPHPNVWGYDLLCSLKSPYSRDSSYKERADTLINEIKAMLGAAFGDGKEMITPSAYDTAWVARIPSIDGSSGSARPQFPQTVDWILKNQLKDGSWGTESHFLLSEPLLATISCVLALFKWQVGDLQVERGIEFLKSSLEKIKNESDQDSLVTDFEIIFPSMLREAQSLHLGLPYDLPYIQLLQTKRQERLANLSREKIHGGILQLSSLEGIEDMVEWERLMDLQSLDGSFLSSPASTAFVFIHTGDLKCLAFLNSVLAKFGAFVPCLYHVDLLERLLIVDNIERLGIDRHFEKEINEALDYVYRYWSNERGIGWGRMNATADLETTALGFRLLRLHRYHVSPVVFKKFKDADGEFLSSIGQFNKDVASMLNLYRACELAFPGENILDEAKGFTAKYLREALEKTETFSSWNIKRNLSQEIKYALKTSWHASIPRVEAKRYCQVYRPDYARLDKSVYKLHHVNNEKILELAKLDFNIIQSILQEEMKNVTSWFRDSGLPLFSFARQRPLEFYFLITAGTYEPRYAKCRLLFTKVACVETVLDDMYDTYGTLDELKLFTQAVRRWDPSLTENLPDYMKRCYKIFYDIVHEAAWEAEKEQGRELVSFLRKAWEDFVLSYHEEAEWLSAEYVPGFDEYIKNGITSIGQRVLLLSGLLVMDGQLLSQKALEKIDYPERSRVLMEQICLISRLADDTQSYKAEKARGELASGIECYMKDHPECTEEEALNHIYGIMEVTAKELTKEYLKVDDDDVPFACKKMLFEETRVTMVIFKDGDRLSNSKLEMKDHFKECLIEPLPL

SEQ ID NO: 474 - protein, 550 aa, Ricinus communis
  (+)-delta-cadinene synthase isozyme A
  ref <308>: DATABASE ACCESSION NUMBER: Genbank Acc. No. EEF38721
MSAQTLAISNLKPNTTRHLASFHPNIWGDRFLSCAAESTDIEDDMEQQVERLKEEVKKMIASADEPSQILNLIDLLQRLGVSYHFEKEIEEALQQVLNMNSDSDKDDDLHSVALRFRLLREQGLNVSCDVFNKFRDRNGHFIQTLKTDLQGMLSLYEAAHFRVHGEGILDDALAFTTTYLESIVPNLSPPLAAQISRTLRQPLRKSLARVEARHFISIYQEDTSHNEVLLTFAKLDFNLLQKLHQKELKYISLWWKDLDFVNKLPFTRDRVVEGYFWILGVYFEPQYHRARKFVTKVINVVSVIDDIYDAYGTLEELVVFTDAINRWDIDCIDQLPEYMKVCYKALLNVYEEIERALSEQGRSYRLHYAKEAMKKLVQAYLVEANWMNKNYVPTMDEYMSIALVSCAYPLLTVTSFVGMGDIATKEVFDWASNDPKIVRVASIICRLMDDIVSHEFEQKRGHIASSVECYMKQNGVSEEATRDEFNKQIVDAWKDINEEHLQPNYVPMPFRTRVVNSARIMDYLYKDDDEYTHVGELMKGSVAALLIDPA

SEQ ID NO: 475 - protein, 394 aa, Ricinus communis
  (+)-delta-cadinene synthase isozyme A
  ref <308>: DATABASE ACCESSION NUMBER: Genbank Acc. No. EEF38510
MGKRDKKQRHHNQHRSRVASYYNTEQEDDGYSYSQSSLPNEDSDAEPDDVEEEEEEEEEKEDTSDAKASNDVPSKFLLYQQSVQSPKGDISYLQKFFLLYVGGRLPLHFQEDFCGTALLSTEWLRSDSRRTAVGVDLDLEALNWCMANNVNKIGADGYSRISLFHGNVLQPSDAELVRFEPQDLISNIKLGEQGDNSENTALESALQVGSSASVSDKYLKRNFQLPARDIVCAFNYSCCCLHKRADLVLYFKHVLDALSKKGGLFVMDLYGGTSSEGKLRLQRRFPNFTYIWEQAEFNIIERKTRISLHFHLQKQQKKLRHAFSYSWRLWSLPEIRDCLEEAGFKSIHFWLRRMPDSKDNRSVEGFGFGRDIKYEEVKTFEQEDSWNAYIVAVA

SEQ ID NO: 476 - protein, 555 aa, Ricinus communis
  casbene synthase
  ref <308>: DATABASE ACCESSION NUMBER: Genbank Acc. No. EEF48772
MAEKDKYRPLANFPSTAWGCSFASFSSSNSDFELYTREVETLKEKVRPMVTASTKDPLENVQIINLLYRLGVSYHFENEITDQLNHIFEIIPNHIISDDNDYDLYTVAILFQILRQYGHKVPCDVFNKFKNSDGKFKKSIANDLKGLLSLYEASFLSVHGENILDEAIAFTRPLLESFADQSSPHLAKYIRNSLLRPHHQGIQRVEARQYISFYEEDESRNETLLKFAKLDFNRLQLLHKQELASLSRYKKYIAQIIIWEDLNLAKELPYIRDRLVETYLWAIGAHFEPQYALSRAIIAKYTTIVSAVDDTYDAYGTLDELQRFTNAFQRCDIDAIDELPDYMKVLYRALLNFFDQIEDEVDEGRSYSTSVAKEAFKELVRSYYVEAQWFSDGYVPSFDEYMRNGLITSTYTVLPAASFIGMENTVGEKEYKWVQSNPKIVKAAKIICRLMDDITTHEDEQKRGHCASSIECYMKEYGVSEKKAIEEIQKICANAWKDMNEECMKKPPTVSRTLLKYYVNLARVIDFVYKNLDSYTYASSLKGDITTVFLELLPV

SEQ ID NO: 477 - protein, 601 aa, Ricinus communis
  casbeye synthase, chloroplastic synthase
  ref <308>: DATABASE ACCESSION NUMBER: Uniprot Acc. No. P59287
MALPSAAMQSNPEKLNLFHRLSSLPTTSLEYGNNRFPFFSSSAKSHFKKPTQACLSSTTHQEVRPLAYFPPTVWGNRFASLTFNPSEFESYDERVIVLKKKVKDILISSTSDSVETVILIDLLCRLGVSYHFENDIEELLSKIFNSQPDLVDEKECDLYTAAIVFRVFRQHGFKMSSDVFSKFKDSDGKFKESLRGDAKGMLSLFEASHLSVHGEDILEEAFAFTKDYLQSSAVELFPNLKRHITNALEQPFHSGVPRLEARKFIDLYEADIECRNETLLEFAKLDYNRVQLLHQQELCQFSKWWKDLNLASDIPYARDRMAEIFFWAVAMYFEPDYAHTRMIIAKVVLLISLIDDTIDAYATMEETHILAEAVARWDMSCLEKLPDYMKVIYKLLLNTFSEFEKELTAEGKSYSVKYGREAFQELVRGYYLEAVWRDEGKIPSFDDYLYNGSMTTGLPLVSTASFMGVQEITGLNEFQWLETNPKLSYASGAFIRLVNDLTSHVTEQQRGHVASCIDCYMNQHGVSKDEAVKILQKMATDCWKEINEECMRQSQVSVGHLMRIVNLARLTDVSYKYGDGYTDSQQLKQFVKGLFVDPISI

SEQ ID NO: 478 - protein, 785 aa, Salvea sclarea
  labdenediol diphosphate synthase
MTSVNLSRAPAAITRRRLQLQPEFHAECSWLKSSSKHAPLTLSCQIRPKQLSQIAELRVTSLDASQASEKDISLVQTPHKVEVNEKIEESIEYVQNLLMTSGDGRISVSPYDTAVIALIKDLKGRDAPQFPSCLEWIAHHQLADGSWGDEFFCIYDRILNTLACVVALKSWNLHSDIIEKGVTYIKENVHKLKGANVEHRTAGFELVVPTFMQMATDLGIQDLPYDHPLIKEIADTKQQRLKEIPKDLVYQMPTNLLYSLEGLGDLEWERLLKLQSGNGSFLTSPSSTAAVLMHTKDEKCLKYIENALKNCDGGAPHTYPVDIFSRLWAIDRLQRLGISRFFQHEIKYFLDHIESVWEETGVFSGRYTKFSDIDDTSMGVRLLKMHGYDVDPNVLKHFKQQDGKFSCYIGQSVESASPMYNLYRAAQLRFPGEEVLEEATKFAFNFLQEMLVKDRLQERWVISDHLFDEIKLGLKMPWYATLPRVEAAYYLDHYAGSGDVWIGKSFYRMPEISNDTYKELAILDFNRCQTQHQLEWIHMQEWYDRCSLSEFGISKRELLRSYFLAAATIFEPERTQERLLWAKTRILSKMITSFVNISGTTLSLDYNFNGLDEIISSANEDQGLAGTLLATFHQLLDGFDIYTLHQLKHVWSQWFMKVQQGEGSGGEDAVLLANTLNICAGLNEDVLSNNEYTALSTLTNKICNRLAQIQDNKILQVVDGSIKDKELEQDMQALVKLVLQENGGAVDRNIRHTFLSVSKTFYYDAYHDDETTDLHIFKVLFRPVV

SEQ ID NO: 479 - protein, 784 aa, Salvea sclarea
  labdenediol diphosphate synthase
MTSVNLSRAPAAIIRRRLQLQPEFHAECSWLKSSSKHAPFTLSCQIRPKQLSQIAELRVTSLDASQASEKDISLVQTPHKVEVNEKIEESIEYVQNLLMTSGDGRISVSPYDTAVIALIKDLKGRDAPQFPSCLEWIAHHQLADGSWGDEFFCIYDRILNTLACVVALKSWNLQSDIIEKGVTYIKENVHKLKGANVEHRTAGFELVVPTFMQMATDLGIQGLPYDHPLIKEIADTKQQRLKEIPKDLVYQMPTNLLYSLEGLGDLEWERLLKLQSGNGSFLTSPSSTAAVLMHTKDEKCLKYIENALKNCDGGAPHTYPVDIFSRLWAIDRLQRLGISRFFQHEIKYFLDHIESVWEETGVFSGRYTKFSDIDDTSMGVRLLKMHGYDVDPNVLKHFKQQDGKFSCYIGQSVESASPMYNLYRAAQLRFPGEEVLEEATKFAFNFLQEMLVKDRLQERWVISDHLFDEIKLGLKMPWYATLPRVEAAYYLDHYAGSGDVWIGKSFYRMPEISNDTYKELAILDFNRCQTQHQLEWIQMQEWYDRCSLSEFGISKRELLRSYFLAAATIFEPERTQERLLWAKTRILSKMITSFVNISGTTLSLDYNFNGLDEIISANEDQGLAGTLLATFHQLLDGFDIYTLHQLKHVWSQWFMKVQQGEGSGGEDAVLLANTLNICAGLNEDVLSNNEYTALSTLTNKICNRLAQIQDNKILQVVDGSIKDKELEQDMQALVKLVLQENGGAVDRNIRHTFLSVSKTFYYDAYHDDETTDLHIFKVLFRPVV

SEQ ID NO: 480 - protein, 575 aa, Salvea sclarea
  sclareol synthase
MSLAFNVGVTPFSGQRVGSRKEKFPVQGFPVTTPNRSRLIVNCSLTTIDFMAKMKENFKREDDKFPTTTTLRSEDIPSNLCIIDTLQRLGVDQFFQYEINTILDNTFRLWQEKHKVIYGNVTTHAMAFRLLRVKGYEVSSEELAPYGNQEAVSQQTNDLPMIIELYRAANERIYEEERSLEKILAWTTIFLNKQVQDNSIPDKKLHKLVEFYLRNYKGITIRLGARRNLELYDMTYYQALKSTNRFSNLCNEDFLVFAKQDFDIHEAQNQKGLQQLQRWYADCRLDTLNFGRDVVIIANYLASLIIGDHAFDYVRLAFAKTSVLVTIMDDFFDCHGSSQECDKIIELVKEWKENPDAEYGSEELEILFMALYNTVNELAERARVEQGRSVKEFLVKLWVEILSAFKIELDTWSNGTQQSFDEYISSSWLSNGSRLTGLLTMQFVGVKLSDEMLMSEECTDLARHVCMVGRLLNDVCSSEREREENIAGKSYSILLATEKDGRKVSEDEAIAEINEMVEYHWRKVLQIVYKKESILPRRCKDVFLEMAKGTFYAYGINDELTSPQQSKEDMKSFVF

SEQ ID NO: 481 - protein, 551 aa, Santalum album
  santalene synthase
MSTQQVSSENIVRNAANFHPNIWGNHFLTCPSQTIDSWTQQHHKELKEEVRKMMVSDANKPAQRLRLIDTVQRLGVAYHFEKEIDDALEKIGHDPFDDKDDLYIVSLCFRLLRQHGIKISCDVFEKFKDDDGKFKASLMNDVQGMLSLYEAAHLAIHGEDILDEAIVFTTTHLKSTVSNSPVNSTFAEQIRHSLRVPLRKAVPRLESRYFLDIYSRDDLHDKTLLNFAKLDFNILQAMHQKEASEMTRWWRDFDFLKKLPYIRDRVVELYFWILVGVSYQPKFSTGRIFLSKIICLETLVDDTFDAYGTFDELAIFTEAVTRWDLGHRDALPEYMKFIFKTLIDVYSEAEQELAKEGRSYSIHYAIRSFQELVMKYFCEAKWLNKGYVPSLDDYKSVSLRSIGFLPIAVASFVFMGDIATKEVFEWEMNNPKIIIAAETIFRFLDDIAGHRFEQKREHSPSAIECYKNQHGVSEEEAVKALSLEVANSWKDINEELLLNPMAIPLPLLQVILDLSRSADFMYGNAQDRFTHSTMMKDQVDLVLKDPVKLDD

SEQ ID NO: 482 - protein, 548 aa, Santalum album
  santalene synthase
MATDNDSSENRRMGNYKPSIWNYDFLQSLATRHNIMEERHLKLAEKLKGQVKFMFGAPMEPLAKLELVDVVQRLGLNHRFETEIKEALFSIYKDESNGWWFGHLHATSLRFRLLRQCGLFIPQDVFKTFQSKTGEFDMKLCDNVKGLLSLYEASFLGWRDENILDEAKAFATKYLKNAWENISQKWLAKRVKHALALPLHWRVPRIEARWFVEAYGEEENMNPTLLKLAKLDFNMVQSIHQKEIGELARWWVTTGLDKLAFARNNLLQSYMWSCAIASDPKFKLARETIVEIGSVLTVVDDAYDVYGSMDELDLYTNSVERWSCTEIDKLPNTLKLIFMAMFNKTNEVGLRVQHERGYSGITTFIKAWVEQCKSYQKEARWYHGGHTPPLEEYSLNGLVSIGFPLLLITGYVAIAENEAALDKVHPLPDLLHYSSLLSRLINDMGTSSDELERGDNLKSIQCYMNQTGASEKVAREHIKGIIEENWKILNECCFDQSQFQEPFVTFNLNSVRGSHFFYEFGDGFGVTNSWTKVDMKSVLIDPIPLDEE

SEQ ID NO: 483 - protein, 551 aa, Santalum album
  santalene synthase
MATLKTDTDASENRRMGNYKPSIWNYDFLQSLATHHNIVEERHLKLAEKLKGQVKFMFGAPMEPLAKLELVDVVQRLGLNHLFETEIKEALFSIYKDGSNGWWFGHLHATSLRFRLLRQCGLFIPQDVFKTFQNKTGEFDMKLWDNVKGLLSLYEASYLGWKGENILDEAKAFTTKCLKSAWENISEKWLAKRVKHALALPLHWRVPRIEARWFIEVYEQEANMNPTLLKLAKLDFNMVQSIHQKEIGELARWWVTTGLDKLDFARNNLLQSYMWSCAIASDPKFKLARETIVEIGSVLTVVDDGYDVYGSMDELDLYTSSVERWSCVKIDKLPNTLKLIFMSMFNKTNEVGLRVQHERGYNSIPTFIKAWVEQCKSYQKEARWFHGGHTPPLEEYSLNGLVSIGFPLLLITGYVAIAENEAALDKVHPLPDLLHYSSLLSRLINDIGTSPDEMARGDNLKSIHCYMNETGASEEVAREHIKGVIEENWKILNQCCFDQSQFQEPFITFNLNSVRGSHFFYEFGDGFGVTDSWTKVDMKSVLIDPIPLGEE

SEQ ID NO: 484 - protein, 569 aa, Santalum album
  santalene synthase
MDSSTATAMRAPFIDHTDHVNLRTDNDSSENRRMGNYKPSIWNYDFLQSLATRHNIMEERHLKLAEKLKGQVKFMFGAPMEPLAKLELVDVVQRLGLNHRFETEIKEALFSIYKDESNGWWFGHLHATSLRFRLLRQCGLFIPQDVFKTFQSKTGEFDMKLCDNVKGLLSLYEASFLGWRDENILDEAKAFATKYLKNAWENISQKWLAKRVKHALALPLHWRVPRIEARWFVEAYGEEENMNPTLLKLAKLDFNMVQSIHQKEIGELARWWVTTGLDKLAFARNNLLQSYMWSCAIASDPKFKLARETIVEIGSVLTVVDDAYDVYGSMDELDLYTNSVERWSCTEIDKLPNTLKLIFMSMFNKTNEVGLRVQHERGYSGITTFIKAWVEQCKSYQKEARWYHGGHTPPLEEYSLNGLVSIGFPLLLITGYVAIAENEAALDKVHPLPDLLHYSSLLSRLINDMGTSSDELERGDNLKSIQCYMNQTGASEKVAREHIKGIIEENWKILNECCFDQSQFQEPFVTFNLNSVRGSHFFYEFGDGFGVTDSWTKVDMKSVLIDPIPLDEE

SEQ ID NO: 485 - protein, 569 aa, Santalum album
  santalene synthase
MDSSTATAMTAPFIDPTDHVNLKTDTDASENRRMGNYKPSIWNYDFLQSLATHHNIVEERHLKLAEKLKGQVKFMFGAPMEPLAKLELVDVVQRLGLNHLFETEIKEALFSIYKDGSNGWWFGHLHATSLRFRLLRQCGLFIPQDVFKTFQNKTGEFDMKLWDNVKGLLSLYEASYLGWKGENILDEAKAFTTKCLKSAWENISEKWLAKRVKHALALPLHWRVPRIEARWFIEVYEQEANMNPTLLKLAKLDFNMVQSIHQKEIGELARWWVTTGLDKLDFARNNLLQSYMWSCPIASDPKFKLARETIVEIGSVLTVVDDGYDVYGSMDELDLYTSSVERWSCVKIDKLPNTLKLIFMSMFNKTNEVGLRVQHERGYNSIPTFIKAWVEQCKSYQKEARWFHGGHTPPLEEYSLNGLVSIGFPLLLITGYVAIAENEAALDKVHPLPDLLHYSSLLSRLINDIGTSPDEMARGDNLKSIHCYMNETGASEEVAREHIKGVIEENWKILNQCCFDQSQFQEPFITFNLNSVRGSHFFYEFGDGFGVTDSWTKVDMKSVLIDPIPLGEE

SEQ ID NO: 486 - protein, 559 aa, Santalum album
  sesquiterpene synthase
  ref <308>: DATABASE ACCESSION NUMBER: Genbank Acc. No. ACF24768
MENQKVPISSVPNLKELSRPIANFPPSIWGDRFINYACEDENEQAQKERQVEELKEQVRRELAATVDKPLQQLNIIDATQRLGIAYHFENEIEESLEHIYLHTYVENNCFQGSHDLYSVALWFRLLRQDGYKVSCDVFDKFRDYEDNFKNSLMEDAKGLLELYEATHLSVHGEEMLDDALEFAKTRLESIVNHLNYPLAEQVRHALYRPLRKGLPRLEAVYFFRIYEAYDSHNKALLKLAKLDFNLLQSLHKKELSDMARWWKSLDFAAKFPFARDRLVEGYFWVLGVYFEPQYSLARKIIIKVFTMISTIDDIYDAYGTLDELELFTKAMQRWDVGSLDQLPEYMKPCYKSILDVYNEIEEEMDNQGSLFRMHYAKEVMKKLVEGYMDEAKWCHEKYVPTFEEYMPVALVTSGYTFLTTISYLGMGEIASKEAFDWLFSHPPVIEASESVCRLMDDMRSHKFEQERGHVASGIECYMKQYGVTEEEAHDEFRKQLVKAWKDINEECLRPYRVPKPLLMRILNLTRVIDVIYKNEDGYTHVKKAMKDNIASLLIDPMIV

SEQ ID NO: 487 - protein, 559 aa, Santalum austrocaledonicum
  sesquiterpene synthase
  ref <308>: DATABASE ACCESSION NUMBER: Genbank Acc. No. ADO87005
MENQKVPISSVPNLKELSRPIANFPPSIWGDRFINYTCEDENEQAQKERQVEELKEQVRRELAATVDKPLQQLNIIDATQRLGIAYHFENEIEESLEHIYLHTYVKNNCFQGSHDLYSVALWFRLLRQDGYKVSCDVFDNFRDYEGNFKNSLMEDAKGLLELYEATHLSVHGEEMLDDALEFAKTRLESIVNHLNYPLAEQVRHALYRPLRKGLPRLEAVYFFRIYEAYHSHNKALLKLAKLDFNLLQSLHRKELGDMARWWRSLDFATKFPFARDRLVEGYFWILGVYFEPQYSLAREITTKVFAMISTIDDIYDAYGTLDELKLFTEAIQRWDVGSLDQLPEYMKPCYKSILDVYNEIEEEMANQGSLFRMHYAKEVMKTIVEGYMDEAKWCHEKYVPTFQEYMSLALVTSGYTFLTTISYLGMGGIASKEAFEWLFSHPPIIEASESICRLMDDMSSHKFEQERGHVASGIECYMKQYGVIEEEAHDEFHKRLVKAWKDINEGFLRPYAVPEPLLMRILNLTRVMDVIYKNEDSYTHVKKAMKDNIASLLIDPMIV

SEQ ID NO: 488 - protein, 562 aa, Santalum spicatum
  sesquiterpene synthase
  ref <308>: DATABASE ACCESSION NUMBER: Genbank Acc. No. ADO87006
MENQKVPISSVPNLKDLDMISRPIANFPPSVWGDRFINYACEDENEQAQKERQVEELKEQVRRELAAAIDKPLQQLNIIDATQRLGIAYHFENEIEESLKHIYLHTYVENTCFEGSDDLCSVALWFRLLRQDGYRVSCDVFKKFRDSEGNFKNSLMEDAKGLLELYEATHLSVNGEEMLDDALEFTKTHLELVVSHLNYPLAEQVRHALYQPQHKGLPRLEAVYFFRIYEAYDSHNEALLKLAKLDFNLLQSLHMKELSHMAKWWKSLDFATKFPFARDRLVEGYFWILGVYFEPQYSLARKIIIKVFTMISTIDDIYDAYGTLDELKLFTKAIQRWDIGSLDQLPEYMKPCYKSVLDVYNEIEEEMDNQGSLFRMHYAKEEMKKIVEGYMDEAKWCHEKYVPTFQEYMSVALVTAGYTFLTTISYLGMGEIASKEAFDWLFSHPPIIEASESVGRLMDDMRSHEFEQERGHVASGIECYMKQYGVTEEEAHDKFHKRLVKAWKDINEGCLRPYPVPKPLLMRILSLTRVIDVIYKNEDWYTHVKKPMKDKIASLLIDPMIV

SEQ ID NO: 489 - protein, 827 aa, Scoparia dulcis
  copalyl disphosphate synthase
  ref <308>: DATABASE ACCESSION NUMBER: Genbank Acc. No. BAA03594
MALATFLRSPPSPGVFAAALHVPSSSTFGRTTTYVFPSYSWKTPVTSSNTSPCNAISRPRTEERIDLIRNGFPTINYWHEIVEDDTQLEITHRETAISSNKIWEMVKTIRGMLRSMEDGEITVSAYDTAWVALVEDIGGSGTPQFPSSLEWISNNQLPDGSWGDGATFSAHDRIINTLACVIALRTWNMHSDKSDRGIAFIRENMYKLEDENEEHMPIGFEVALPSLIEIAKKIDIDIPDESPIFEKRLRKKRFKLKRIPRDIMHKVPTTLLHSLEGMPALDWEKLINLQSADGSFLFSPSSTAFALQQTKDHNCLHYPARHLQKFNGGVPNVYPVDLFEHLWAVDRLERLGLSRYFQPEIEECIDYVHGHWTSKGICWARNSEVKDIDDTAMGFRLLKLHGYEVSADVFKHFENGGEFFCFVGQSTQAVTGMYNLFRASQVMFPGEDILSNAKSFLSKFLQEKRANNELLDKWIITKDLPGEVGYALDVPWYASLPRVETRLYLEQYGGQDDVWIGKTLYRMPYVNNNTYLELAKLDYNNCQASHQQEWKSIQKWYSRCNFGEYGMSERSLLLAYYIAAASIFEPERALERLAWAKTAILMETIETILKDNSSQESGNVLSSMNPNLMAAACMQTEQVAGITKQERLTETLVRASKPLLIGTRCWHTAGTSISNCIMGRKSGLRTCEERDVHSGQGDAELLVRTLNLCGGGGRWVSEELLLSHPKYQHLLEVTNRVCHQLRLFQRRQACDVNGGCMTDVGGILSAQIESNMQELAKLVPTKSSSGDLDSDTKQNFLTVARSFYYAVYCNPGSINFHIAKVLFERVL

SEQ ID NO: 490 - protein, 544 aa, Solanum habrochaites; identical to SEQ ID NO: 440
  sesquiterpene synthase 1
  ref <308>: DATABASE ACCESSION NUMBER: Genbank Acc. No. AAG41891

SEQ ID NO: 491 - protein, 546 aa, Solanum habrochaites; identical to SEQ ID NO: 441
  sesquiterpene synthase 2
  ref <308>: DATABASE ACCESSION NUMBER: Genbank Acc. No. AAG41892

SEQ ID NO: 492 - protein, 548 aa, Solanum lycopersicum
  caryophyllene/alpha-humulene synthase
  ref <308>: DATABASE ACCESSION NUMBER: Uniprot Acc. No. D5KXD2
MASSSANKCRPLANFHPTVWGYHFLSYTHEITNQEKVEVDEYKETIRKMLVEAPEGSEQKLVLIDAMQRLGVAYHFDNEIETSIQNIFDASSKQNDNDNNLYVVSLRFRLVRQQGHYMSSDVFKQFINQDGKFKETLTNDVQGLLSLYEASHLRVRDEEILEEALTFTTTHLESTVSNLSNNNSLKAEVTEAFSQPIRMTLPRVGARKYISIYENNDAHNHLLLKFAKLDFNMLQKLHQRELSDLTRWWKDLDFANKYPYARDRLVECYFWILGVYFEPKYSRARKMMTKVIQMASFFDDTFDAYATFDELEPFNNAIQRWDINAIDSVPPYLRHAYQALLDIYSEMEQALAKEFKSDRVYYAKYEMKKLVRAYFKEAQWLNNDNHIPKYEEHMENAMVSAGYMMGATTCLVGVEEFISKETFEWMINEPLIVRASSLIARAMDDIVGHEVEQQREHGASLIECYMKDYGVSKQEAYVKFQKEVTNGWMDINREFFCPDVEVPKFVLERVLNFTRVINTLYKEKDEYTNSKGKFKNMIISLLVESVEI

SEQ ID NO: 493 - protein, 800 aa, Solanum lycopersicum
  copalyl diphosphate synthase
  ref <308>: DATABASE ACCESSION NUMBER: Genbank Acc. No. BAA84918
MSISASFLRFSLTAHYQPSPSSSPPNQPFKFLKSNREHVEFNRILQCHAVSRRRTKDYKEVQSGSLPVIKWDDIAEEVDEETHTLEVYDPSSNEDHIDAIRSMLGSMGDGEISVSAYDTAWVAMVKDVKGTETPQFPSSLEWIANNQLADGSWGDNSIFLVYDRVINTLACVIALKSWNLHPDKILLGMSFMRENLSRIGDENAEHMPIGFEVAFPSLIEIAKKLGLDFPYDSPVLQDIYASRQLKLTRIPKDIMHKVPTTLLHSLEGMTDLDWQKLLQFQCTDGSFLFSPSSTAYALMQTQDHNCLNYLKNAVHKFNGGVPNVYPVDLFEHIWTVDRLQRLGISRYFELKIKKCIDYFSKYWTNKGICWARNSPVQDIDDTAMAFRLLRLHGYAVSADVFKHFESKGEFFCFVGQSNQAVTGMYNLYRASHVMFSGEKILENAKISTSNYLREKRAQNQLLDKWIITKDLPGEVGYALDVPWYASLPRLETRFFLEHYGGEDDVWIGKTLYRMPLVNNSLYLELAKSDYNNCQALHQFEWRRIRKWYYECGLREFGLSEKRLLVTYYLGSASIFEAQRSTERMAWVKTAALMDCVRSCFGSPQVSAAAFLCEFAHYSSTALNSRYNTEDRLVGVILGTLNHLSLSALLTHGRDIHHYLRHAWENWLLTVGEGEGEGEGGAELIIRTLNLCSVHWISEEILLSHPTYQKLLEITNRVSHRLRLYKGHSEKQVGMLTFSEEIEGDMQQLAELVLSHSDASELDANIKDTFLTVAKSFYYSAYCDDRTINFHIAKVLFERVV

SEQ ID NO: 494 - protein, 548 aa, Solanum lycopersicum; identical to SEQ ID NO: 437
  germacrene C synthase
  ref <308>: DATABASE ACCESSION NUMBER: Genbank Acc. No. AAC39432

SEQ ID NO: 495 - protein, 556 aa, Solanum lycopersicum
  vetispiradiene synthase
  ref <308>: DATABASE ACCESSION NUMBER: Genbank Acc. No. AAG09949
MASAAALVSNYREEEIVRPVADFSPSLWGDRFHSFSLDNKIAGKYAQEIETLKEQSRVILSASSGTTLAQKLDLIDIVERLGLAYHFEKQIDDVLDQIYKADPNSEAQEYNDLQTSSIQFRLLRQHGYNISPKLFSRFQDAKGKFNESLSNDIKGLLNLYEASHVRTHGEDILEEALAFSTAHLESAAPHLKSPLSKQVTHALEQSLHKSIPRVETRYFISIYEEEEQKNDLLLRFAKLDFNLLQMLHKQELSEVSRWWKDLDFVTTLPYARDRAVECYFWTMGVYAEPQYSQARVMLAKTIAMISIVDDTFDAYGIVKELEVYTDAIQRWDISHIDRLPDYMKISYKALLDLYDDYETELSKDGRSDVVHYAKERMKEIVRNYFVEAKWFIEGYMPPVSEYLCNALATSTYYLLTTTSYLGVKSANKEDFEWLAKNPKILEANVTLCRVIDDIATYDVEKGRGQIATGIECYMRDYGVSTEEAMEKFEEMAEIAWKDVNEGILRPTPVSTEILTRILNLARIIDVTYKHNQDGYRHPEKVLKPHIIALLVDSIEI

SEQ ID NO: 496 - protein, 556 aa, Solanum tuberosum
  putative vetispiradiene synthase 4
  ref <308>: DATABASE ACCESSION NUMBER: Genbank Acc. No. AAD02269
MALAAAVMSNYGEEEIVRPVADFSPSLWGDRFHYFSLDNQVEKEYAQEIETLKEQTRSMLLAASGMTLAEKLNLIDIVERLGLAYHFEKQIEDMLDQIYKAHPNFESHEYSDLTTLSVQFRLLRQHGYNISPKIFSRYQDAKGKFNEPLSNDIKGLLNLYEASHVRTHGEDILEEALAFSTAHLESAAPHLKSPLSKQVTHALEQSLHKSIPRVETRYFISIYEEEEHKNDVLLRFAKLDFNLLQMLHKQELSEVSRWWKDLDFVTTLPYARDRAVECYFWTMGVYAEPQYSQARVMLAKTIAMISIVDDTFDAYGIVKELEVYTDAIQRWDISQIDRLPDYMKISYKALLDLYNDYETELSMDGRSDVVHYAKERMKEIVRNYFVEAKWFIEGYMPPVSEYLSNALATSTYYLLTTTSYLGVKSANKEDFEWLAKNPKILEANVTLCRVIDDIATYEVEKGRGQIATGIECYMRDYGVSTEVAMEKFQEMAEIAWKDVNEGILRPTPISTEILTRILNLARIIDVTYKHNQDGYTHPEKVLKPHIIALLVDSIEI

SEQ ID NO: 497 - protein, 556 aa, Solanum tuberosum
  vetispiradiene synthase
  ref <308>: DATABASE ACCESSION NUMBER: Genbank Acc. No. BAA82092
MTPAAVVMSNYGEEEIVRPIADFSPSLWGDRFHSFSLDNQIAGKYAQEIETLKEQSRIILSASSRRTLAEKLDLIDIVERLGIAYHFEKQIDDMLDQFYKADPNFEAHEYNDLQTLSVQFRLLRQHGYNISPKLFIRFQDAKGKFKESLCNDIKGLLNLYEASHVRTHGEDILEEALAFSTAHLESAAPHLKSPLSKQVTHALEQSLHKSIPRVETRYFISIYEEEEQKNDVLLQFAKLDFNLLQMLHKQELSEVSRWWKDLDFVTTLPYARDRAVECYFWTMGVYAEPQYSQARVMLAKTIAMISIVDDTFDAYGIVKELEIYTDAIQRWDISQIDRLPDYMKISYKALLDLYNDYEMELSKDGRSDVVHYAKERMKEIVRNYFVEAKWFIEGYMPPVSEYLSNALATSTYYLLTTTSYLGMKSANKQDFEWLAKNPKILEANVTLCRVIDDIATYEVEKGRGQIATGIECYMRDYGVSTEKAMEKFQEMAETAWKDVNEGILRPTPVSTEILTRILNLARIIDVTYKHNQDGYTHPEKVLKPHIIALLVDSIEI

SEQ ID NO: 498 - protein, 549 aa, Solidago canadensis
  germacrene A synthase
  ref <308>: DATABASE ACCESSION NUMBER: Genbank Acc. No. CAC36896
MAAKQVEVIRPVANYHPSLWGDQFLHYDEQEDEHVEVDQQIEILKEETRKEILASLDDPTKHTNLLKLIDVIQRLGIAYYFEHEITQALDHIYSVYGDEWNGGRTSLWFRLLRQQGFYVSCDIFNIYKLDNGSFKDSLTKDIECMLELYEAAYMRVQGEIILDEALEFTKTHLEHIAKDPLRCNNTLSRHIHEALERPVQKRLPRLDAIRYIPFYEQQDSHNKSLLRLAKLGFNRLQSLHKKELSQLSKWWKEFDAPKNLPYVRDRLVELYFWILGVYFEPQYSRSRIFLTKTIKMAAILDDTYDIYGTYEELEIFTKAVQRWSITCMDTLPDYMKVIYKSLLDVYEEMEEIIEKDGKAYQVHYAKESMIDLVTSYMTEAKWLHEGHVPTFDEHNSVTNITGGYKMLTASSFVGMHGDIVTQESFKWVLNNPPLIKASSDISRIMNDIVGHKEEQQRKHIASSVEMYMKEYNLAEEDVYDFLKERVEDAWKDINRETLTCKDIHMALKMPPINLARVMDMLYKNGDNLKNVGQEIQDYMKSCFINPMSV

SEQ ID NO: 499 - protein, 551 aa, Solidago canadensis
  germacrene D synthase
  ref <308>: DATABASE ACCESSION NUMBER: Genbank Acc. No. CAE47440
MAAKQGEVVRPDADYSYHPSLWGDQFLHYDEQEDDQVEVDQQIEILKEETRREILSSLDDPAKHTNLLKLIDVIQRLGIAYYFEHEITQALDHIYNVYGDEWNGGSTSLWFRLLRQQGFYVSCDIFNIYKLDNGSFKDSLTKDIECMLELYEAAYMRVQGEIILDEALEFTKTHLEQIAKDPLRCNNTLSRHIYEALKRPIRKRLPRVDALQYMPFYEQQDSHNKSLLRLAKLGFNRLQSLHKKELSQLSKWWKEFDAPKNLRYVRDRLVELYFWVLGVYFEPQYSRSRIFLTKVIKMATILDDTYDIHGTYEELEIFTKAVQRWSITCMDTLPDYMKMIYKSLLDVYEEMEEIIEKDGKAYQVHYAKDSMIDLVTSYMTEAKWLHEGHVPTFEEYNSITNLTGGYKMLTTSSFVDMPGDIVTQESFRWALNNPPLIKASADVSRIMDDIVGHKEEQQRKHLPSRVEMYMKKYHLAEEDVYDLLKQRVEDAWKDLNRETLTCKDIHMALKMRPINLARVIDMLYKNDDNLKNVGQEIQDYIKSCFINAISV

SEQ ID NO: 500 - protein, 787 aa, Stevia rebaudiana
  (-)-copalyl diphosphate synthase
  ref <308>: DATABASE ACCESSION NUMBER: Genbank Acc. No. AAB87091
MKTGFISPATVFHHRISPATTFRHHLSPATTNSTGIVALRDINFRCKAVSKEYSDLLQKDEASFTKWDDDKVKDHLDTNKNLYPNDEIKEFVESVKAMFGSMNDGEINVSAYDTAWVALVQDVDGSGSPQFPSSLEWIANNQLSDGSWGDHLLFSAHDRIINTLACVIALTSWNVHPSKCEKGLNFLRENICKLEDENAEHMPIGFEVTFPSLIDIAKKLNIEVPEDTPALKEIYARRDIKLTKIPMEVLHKVPTTLLHSLEGMPDLEWEKLLKLQCKDGSFLFSPSSTAFALMQTKDEKCLQYLTNIVTKFNGGVPNVYPVDLFEHIWVVDRLQRLGIARYFKSEIKDCVEYINKYWTKNGICWARNTHVQDIDDTAMGFRVLRAHGYDVTPDVFRQFEKDGKFVCFAGQSTQAVTGMFNVYRASQMLFPGERILEDAKKFSYNYLKEKQSTNELLDKWIIAKDLPGEVGYALDIPWYASLPRLETRYYLEQYGGEDDVWIGKTLYRMGYVSNNTYLEMAKLDYNNYVAVLQLEWYTIQQWYVDIGIEKFESDNIKSVLVSYYLAAASIFEPERSKERIAWAKTTILVDKITSIFDSSQSSKEDITAFIDKFRNKSSSKKHSINGEPWHEVMVALKKTLHGFALDALMTHSQDIHPQLHQAWEMWLTKLQDGVDVTAELMVQMINMTAGRWVSKELLTHPQYQRLSTVTNSVCHDITKLHNFKENSTTVDSKVQELVQLVFSDTPDDLDQDMKQTFLTVMKTFYYKAWCDPNTINDHISKVFEIVI

SEQ ID NO: 501 - protein, 784 aa, Stevia rebaudiana
  (-)-ent-kaurene synthase
  ref <308>: DATABASE ACCESSION NUMBER: Genbank Acc. No. AAD34295
MNLSLCIASPLLTKSNRPAALSAIHTASTSHGGQTNPTNLIIDTTKERIQKQFKNVEISVSSYDTAWVAMVPSPNSPKSPCFPECLNWLINNQLNDGSWGLVNHTHNHNHPLLKDSLSSTLACIVALKRWNVGEDQINKGLSFIESNLASATEKSQPSPIGFDIIFPGLLEYAKNLDINLLSKQTDFSLMLHKRELEQKRCHSNEMDGYLAYISEGLGNLYDWNMVKKYQMKNGSVFNSPSATAAAFINHQNPGCLNYLNSLLDKFGNAVPTVYPHDLFIRLSMVDTIERLGISHHFRVEIKNVLDETYRCWVERDEQIFMDVVTCALAFRLLRINGYEVSPDPLAEITNELALKDEYAALETYHASHILYQEDLSSGKQILKSADFLKEIISTDSNRLSKLIHKEVENALKFPINTGLERINTRRNIQLYNVDNTRILKTTYHSSNISNTDYLRLAVEDFYTCQSIYREELKGLERWVVENKLDQLKFARQKTAYCYFSVAATLSSPELSDARISWAKNGILTTVVDDFFDIGGTIDELTNLIQCVEKWNVDVDKDCCSEHVRILFLALKDAICWIGDEAFKWQARDVTSHVIQTWLELMNSMLREAIWTRDAYVPTLNEYMENAYVSFALGPIVKPAIYFVGPKLSEEIVESSEYHNLFKLMSTQGRLLNDIHSFKREFKEGKLNAVALHLSNGESGKVEEEVVEEMMMMIKNKRKELMKLIFEENGSIVPRACKDAFWNMCHVLNFFYANDDGFTGNTILDTVKDIIYNPLVLVNENEEQR

SEQ ID NO: 502 - protein, 784 aa, Stevia rebaudiana
  kaurene synthase
  ref <308>: DATABASE ACCESSION NUMBER: Genbank Acc. No. AAD34294
MNLSLCIASPLLTKSSRPTALSAIHTASTSHGGQTNPTNLIIDTTKERIQKLFKNVEISVSSYDTAWVAMVPSPNSPKSPCFPECLNWLINNQLNDGSWGLVNHTHNHNHPLLKDSLSSTLACIVALKRWNVGEDQINKGLSFIESNLASATDKSQPSPIGFDIIFPGLLEYAKNLDINLLSKQTDFSLMLHKRELEQKRCHSNEIDGYLAYISEGLGNLYDWNMVKKYQMKNGSVFNSPSATAAAFINHQNPGCLNYLNSLLDKFGNAVPTVYPLDLYIRLSMVDTIERLGISHHFRVEIKNVLDETYRCWVERDEQIFMDVVTCALAFRLLRIHGYKVSPDQLAEITNELAFKDEYAALETYHASQILYQEDLSSGKQILKSADFLKGILSTDSNRLSKLIHKEVENALKFPINTGLERINTRRNIQLYNVDNTRILKTTYHSSNISNTYYLRLAVEDFYTCQSIYREELKGLERWVVQNKLDQLKFARQKTAYCYFSVAATLSSPELSDARISWAKNGILTTVVDDFFDIGGTIDELTNLIQCVEKWNVDVDKDCCSEHVRILFLALKDAICWIGDEAFKWQARDVTSHVIQTWLELMNSMLREAIWTRDAYVPTLNEYMENAYVSFALGPIVKPAIYFVGPKLSEEIVESSEYHNLFKLMSTQGRLLNDIHSFKREFKEGKLNAVALHLSNGESGKVEEEVVEEMMMMIKNKRKELMKLIFEENGSIVPRACKDAFWNMCHVLNFFYANDDGFTGNTILDTVKDIIYNPLVLVNENEEQR

SEQ ID NO: 503 - protein, 862 aa, Taxus wallilchiana
  var. chinensis taxadiene synthase
  ref <308>: DATABASE ACCESSION NUMBER: Uniprot Acc. No. Q9FT37
MAQLSFNAALKMNALGNKAIHDPTNCRAKSEGQMMWVCSKSGRTRVKMSRGSGGPGPVVMMSSSTGTSKVVSETSSTIVDDIPRLSANYHGDLWHHNVIQTLETPFRESSTYQERADELVVKIKDMFNALGDGDISPSAYDTAWVARVATISSDGSEKPRFPQALNWVFNNQLQDGSWGIESHFSLCDRLLNTTNSVIALSVWKTGHSQVEQGTEFIAENLRLLNEEDELSPDFEIIFPALLQKAKALGINLPYDLPFIKYLSTTREARLTDVSAAADNIPANMLNALEGLEEVMDWKKIMRFQSKDGSFLSSPASTACVLMNTGDEKCFTFLNNLLVKFGGCVPCMYSIDLLERLSLVDNIEHLGIGRHFKQEIKVALDYVYRHWSERGIGWGRDSLVPDLNTTALGLRTLRTHGYDVSSDVLNNFKDENGRFFSSAGQTHVELRSVVILFRASDLAFPDEGAMDDARKFAEPYLRDALATKISTNTKLFKEIEYVVEYPWHMSIPRSEARSYIDSYDDDYVWERKTLYRMPSLSNSKCLELAKLDFNIVQSLHQEELKLLTRWWKESGMADINFTRHRVAEVYFSSATFEPEYSATRIAFTKIGCLQVLFDDMADIFATLDELKSFTEGVKRWDTSLLHEIPECMQTCFKVWFKLIEEVNNDVVKVQGRDMLAHIRKPWELYFNCYVQEREWLDAGYIPTFEEYLKTYAISVGLGPCTLQPILLMGELVKDDVVEKVHYPSNMFELVSLSWRLTNDTKTYQAEKARGQQASGIACYMKDNLGATEEDAIKHICRVVDRALKEASFEYFKPSNDIPMGCKSFIFNLRLCVQIFYKFIDGYGIANEEIKDYIRKVYIDPIQV

SEQ ID NO: 504 - protein, 557 aa, Vitis vinifera
  (-)-germacrene D synthase
  ref <308>: DATABASE ACCESSION NUMBER: Genbank Acc. No. AAS66357
MSVQSSGVLLAPSKNLSPEVGRRCANFHPSIWGDHFLSYASEFTNTDDHLKQHVQQLKEEVRKMLMAADDDSAQKLLLIDAIQRLGVAYHFESEIDEVLKHMFDGSVVSAEEDVYTASLRFRLLRQQGYHVSCDLFNNFKDNEGNFKESLSSDVRGMLSLYEATHFRVHGEDILDEALAFTTTHLQSATKHSSNPLAEQVVHALKQPIRKGLPRLEARHYFSVYQADDSHNKALLKLAKLDFNLLQKLHQKELSDISAWWKDLDFAHKLPFARDRVVECYFWILGVYFEPQFFFARRILTKVIAMTSIIDDIYDVYGTLEELELFTEAVERWDISAIDQLPEYMRVCYQALLYVYSEIEEEMAKEGRSYRLYYAKEAMKNQVRAYYEEAKWLQVQQIPTMEEYMPVALVTSAYSMLATTSFVGMGDAVTKESFDWIFSKPKIVRASAIVCRLMDDMVFHKFEQKRGHVASAVECYMKQHGASEQETPNEFPQPVREAWKDINEECLIPTAVPMPILMRVLNLARVIDVIYKNEDGYTHFGAVLKDFVTSMLIDPVPI

SEQ ID NO: 505 - protein, 547 aa, Zea diploperennis
  (E)-beta-caryophyllene synthase
  ref <308>: DATABASE ACCESSION NUMBER: Genbank Acc. No. ABY79209
MAADEARSVSRLHSEEDMHGKHHSTLWGDFFLHHVPCRPGQYLIMKDKVKIMKEEVKKMLLDVGSSDLSHKLDCINTLERLGLDYHYTKEIDELMCNVFEARDQDLDLTTTSQLFYLLRKHGYHVSSDVFLKFRDDKGDIVTDDARCLLRMYEAAHVRVNGEEILDNILIHTKRQLQCIVDDLEPTLQEEVRYALETPLFRRLNRVQARQFISTYEKSTTRNNMLLEFSKLDFNILLTLYCEELKDLTLWWKEFQAQANTAIYARDRMVEMHFWMMGVFFEPQYSYSRKMLTQLFMIVSVLDDLYDSHCTTEEGNTFTAALQRWDEEGVEQCPTYLRTLYTNIRATVKAIEEDLNLQNNKHAKLVKGLIIDMAMCYNAETEWRDKKYVPATVDEHLKISARSSGCMHLVSQGFISMGDVATSEALEWASTYPKIVRAVCIIARLANDIMSYKREASNNTMVSTVQTCAKEYGTTTVEQAIEKIRELIEEAWMDITHECLRQPQPKALLERAVNLARTMDFLYKDVDGYTDSRSIKGILDSLYVHLID

SEQ ID NO: 506 - protein, 547 aa, Zea luxurians
  (E)-beta-caryophyllene synthase
  ref <308>: DATABASE ACCESSION NUMBER: Genbank Acc. No. ABY79211
MAADEARSVSRLHGEEDMHGKHHSTLWGDFFLHHVPCRPGQYLIMKDNVEIMKEEVKKMLLDVGSSDLSHKLDCIDTLGRLGLDYHYTKEIDELMCNVFEAMDQDLDLTTTSQLFYLLRKHGYHISSDVFLKFRDDKGDIVTNDARCLLRMYEAAHVRVNGEEILDNILIHTKRQLQCIVDDLEPTLQEEVRYALETPLFRRLNRVQARQFISTYEKSTTRNNMLLEFSKLDFNILLTLYCEELKDLTLWWKEFQAQANMTIYARDRMVEMHFWMMGVFFEPQYSYSRKMLTRLFMIVSVLDDLYDSHCTTEEGNAFTAALQRWDEEGVEQCPTYLRTLYTNIRATVKAIEEDLNLQNNKHAKLVKGLIIDMAMCYNAETEWRDKKYVPATVDEHLKISARSSGCMHLVSQGFISMGDVATSEALEWASTYPKIVRAVCIIARLANDIMSYKREASNNTMVSTVQTCAKEYGTTTVEQAIEKIRELIEEAWMDITHECLRQPQPKALLERAVNLARTMDFLYKDVDGYTDSRSIKGILDSLYVHLID

SEQ ID NO: 507 - protein, 547 aa, Zea mays
  huehuetenangensis (E)-beta-caryophyllene synthase
  ref <308>: DATABASE ACCESSION NUMBER: Genbank Acc. No. ABY79210
MAADEARSVSRLHSEEDMHGKHHSTLWGDFFLHHVPCRPGQYSIMKDNVKIMKEEVKKMLLDVGSSDLSHKLECIDTLERLGLDYHYTKEIDELMCNVFEARDQDLDLTTTSQLFYLLRKHGYHVSSDVFLKFGDDKGDIVTDDARCLLRMYEAAHVRVNGEEILDNILIHTKRQLQCIVDDLEPTLQEEVRYALETPLFRRLNRVQARQFISTYEKSTMRNNMLLEFSKLDFNILLTLYCEELKDLTMWWKEFQAQANTTIYARDRMVEMHFWMMGVFFEPQYSYSRKMLTQLFMIVSVLDDLYDSHCTTEEGNAFTAALQRWDEEGVEQCPTYLRTLYTNIRATVKAIEEDLNLQNNKHAKLVKGLIIDMAMCYNAETEWRDKKYVPATVDEHLKISARSSGCMHLVSQGFISMGDVATSEALEWASTYPKIVRAVCIIARLANDIMSYKREASNNTMVSTVQTCAKEYGTTTVEQAIEKIRELIEEAWMDITHECLRQPQPMALLERAVNLARTMDFLYKDVDGYTDSWSIKGILDSLYVHLID

SEQ ID NO: 508 - protein, 548 aa, Zea mays
  (-)-beta-macrocarpene synthase
  ref <308>: DATABASE ACCESSION NUMBER: Genbank Acc. No. AAS88576
MAAPTLTADGPRLGQQEMKKMSPSFHPTLWGDFFLSYEAPTEAQEAQMREKAAVLKEEVRNMIKGSHDVPEIVDLIITLQRLNLDYHYEDEINEKLTVVYKSNYDGGNLDLVSRRFYLLRKCGYDVSSDVFLKFKDQLGNFVEADTRSLLSLYNAAFLRIHGETVLDEAISFTMRVLQDRLEHLESPLAEEVSSALDTPLFRRVGTLEMKDYIPIYEKDAKQNKSILEFAKLNFNLLQLRYSSELKECTTWWKELRVESNLSFVRDRIVEVYFWMSGGCYDPQYSHSRIILTKIVAFITILDDTLDSHATSCESMQLAEAIERWDESAVSLLPEYMKDFYMYLLKTFSSFENELGPDKSYRVFYLKEAVKELVREYTKEIKWRDEDYVPKTLKEHLKVSLISIGGTLVLCSAFVGMGDVVTKKIMKWVMSDAELVKSFGIFVRLSNDIVSTKREQREKHCVSTVQCYMKQHEITMDEACEQIKELTEDSWKFMIEQGLALKEYPIIVPRTVLEFARTVDYMYKEADKYTVSHTIKDMLTSLYVKPVLM

SEQ ID NO: 509 - protein, 548 aa, Zea mays
  (-)-beta-macrocarpene synthase
  ref <308>: DATABASE ACCESSION NUMBER: Genbank Acc. No. AAT70085
MAAPTLTADGPRLGQQEMKKMSPSFHPTLWGDFFLSYEAPTEAQEAQMREKAAVLKEEVRNMIKGSHDVPEIVDLIITLQRLNLDYHYEDEINEKLTVVYKSNYDGGNLDLVSRRFYLLRKCGYDVSSDVFLKFKDQLGNFVEADTRSLLSLYNAAFLRIHGETVLDEAISFTMRVLQDRLEHLESPLAEEVSSALDAPLFRRVGTLEMKDYIPIYEKDAKQNKSILEFAKLNFNLLQLRYSSELKECTTWWKELRVESNLSFVRDRIVEVYFWMSGGCYDPQYSHSRIILTKIVAFITILDDTLDSHATSCESMQLAEAIERWDESAVSLLPEYMKDFYMYLLKTFSSFENELGPDKSYRVFYLKEAVKELVREYTKEIKWRDEDYVPKTLKEHLKVSLISIGGTLVLCSAFVGMGDVVTKKIMKWVMSDAELVKSFGIFVRLSNDIVSTKREQREKHCVSTVQCYMKQHEITMDEACEQIKELTEDSWKFMIEQGLALKEYPIIVPRTVLEFARTVDYMYKEADKYTVSHTIKDMLTSLYVKPVLM

SEQ ID NO: 510 - protein, 548 aa, Zea mays
  (-)-beta-macrocarpene synthase
  ref <308>: DATABASE ACCESSION NUMBER: Genbank Acc. No. ACF58240
MAAPTLTTDGPRLGQQEMKKMSPSFHPTLWGDFFLSYEAPTEAQEAEMRQRAEVLREEVRNMIKGSHDVPEIVDLIITLQRLNLDYHYEDEINEKLAVVYNSNYDGGNLDLVSRRFYLLRKCGYHVSSDVFLNFKDQYGNFIEVDTRSLLSLYNAAYLRIHGETVLDEAISFTTRCLQDRLEHLESPIAEEVSSALDTPLFRRVGTLEMKDYIPIYEKDAKQNKSILEFAKLNFNLLQLLYSSELKECTTWWKELRVESNLSFVRDRIVEVYFWMSGGCYDPQYSHSRIILTKIVAFITILDDTLDSHANSYESMQLAEAVERWDESAVSLLPEYMKDFYMYLLKTFSSFENELGPDKSYRVFYLKEAVKELVREYTKEIKWRDEDYVPKTLKEHLKVSLISIGGTLVLCSAFVGMGDVVTKKIMEWVMSDAELVKSFGIFVRLSNDIVSTKREQREKHCVSTVQCYMKQHELTMDEACEQIKELTEDSWKFMIEQGLALKEYPIIVPRTVLEFARTVDYMYKEADKYTVSHTIKDMLTSLYVKPVLM

SEQ ID NO: 511 - protein, 547 aa, Zea mays
  (E)-beta-caryophyllene synthase
  ref <308>: DATABASE ACCESSION NUMBER: Genbank Acc. No. ABY79206
MAADEARSVSRLHSEEDMHGKHHSTLWGDFFLHHVPCRPGQYLIMKDNVEIMKEEVKKMLLDVGSSDLSHKLDCIDTLERLGLDYHYTKEIDELMCNVFEARDQDLDLTTTSQLFYLLRKHGYHISSDVFLKFRDDKGDIVTNDARCLLRMYEAAHVRVNGEEILDNILIHTKRQLQCIVDDLEPTLQEEVRYALETPLFRRLNRVQARQFISTYEKSTTRINMLLEFSKLDFNILLTLYCEELKDLTLWWKEFQAQANTTIYARDRMVEMHFWMMGVFFEPQYSYSRKMLTQLFMIVSVLDDLYDSHCTTEEGNAFTAALQRWDEEGVEQCPTYLRTLYTNIRATIKAIEEDLNFQNNKHAKLVKGLIIDMAMCYNAETEWRDKKYVPATVDEHLKISARSSGCMHLVSQGFISMGDVATSEALEWASTYPKIVRAVCIIARLANDIMSYKREASNNTMVSTVQTCAKEYGTTTVEQAIEKIRELIEEAWMDITHECLRQPQPKALLERAVNLARTMDFLYKDADGYTDSRSIKGILDSLYVHLID

SEQ ID NO: 512 - protein, 590 aa, Zea mays
  (E,E)-farnesol synthase
  ref <308>: DATABASE ACCESSION NUMBER: Genbank Acc. No. AAO18435
MAMPVKLTPASLSLKAVCCRFSSGGHALRFGSSLPCWRRTPTQRSTSSSTTRPAAEVSSGKSKQHDQEASEATIRQQLQLVDVLENMGISRHFAAEIKCILDRTYRSWLQRHEEIMLDTMTCAMAFRILRLNGYNVSSDELYHVVEASGLHNSLGGYLNDTRTLLELHKASTVSISEDESILDSIGSRSRTLLREQLESGGALRKPSLFKEVEHALDGPFYTTLDRLHHRWNIENFNIIEQHMLETPYLSNQHTSRDILALSIRDFSSSQFTYQQELQHLESWVKECRLDQLQFARQKLAYFYLSAAGTMFSPELSDARTLWAKNGVLTTIVDDFFDVAGSKEELENLVMLVEMWDEHHKVEFYSEQVEIIFSSIYDSVNQLGEKASLVQDRSITKHLVEIWLDLLKSMMTEVEWRLSKYVPTEKEYMINASLIFGLGPIVLPALYFVGPKISESIVKDPEYDELFKLMSTCGRLLNDVQTFEREYNEGKLNSVSLLVLHGGPMSISDAKRKLQKPIDTCRRDLLSLVLREESVVPRPCKELFWKMCKVCYFFYSTTDGFSSQVERAKEVDAVINEPLKLQGSHTLVSDV

SEQ ID NO: 513 - protein, 554 aa, Zea mays
  sesquithujene synthase
  ref <308>: DATABASE ACCESSION NUMBER: Genbank Acc. No. AAS88574
MASPPAHRSSKAADEELPKASSTFHPSLWGSFFLTYQPPTAPQRANMKERAEVLRERVRKVLKGSTTDQLPETVNLILTLQRLGLGYYYENEIDKLLHQIYSNSDYNEKDLNLVSQRFYLLRKNGYDVPSDVFLNFKTEEGGFACAAADTRSLLSLYNAAYLRKHGEEVLDEAISSTRLRLQDLLGRLLPESPFAKEVSSSLRTPLFRRVGILEARNYIPIYEKEATRNEAVLELAKLNFNLQQLDFCEELKHCSAWWNEMIAKSKLTFVRDRIVEEYFWMNGACCDPPYSLSRIILTKITGLITIIDDMFDTHGTTEDCMKFAEAFGRWDESAIHLLPEYMKDFYILMLETFQSFEDALGPEKSYRVLYLKQAMERLVELYSKEIKWRDQDYVATMSEHLQVSAESIGANALTCSAYAGMGDMSITKETFEWALSFPQFIRTFGSFVRLSNDVVSTKREQTKDHSPSTVHCYMKEHGTTMDDACEKIKELIEDSWKDMLEQSLALKGLPKVVPQLVFDFSRTTDNMYRDRDALTSSEALKEMIQLLFVEPIPE

SEQ ID NO: 514 - protein, 554 aa, Zea mays
  S-beta-bisabolene synthase
  ref <308>: DATABASE ACCESSION NUMBER: Genbank Acc. No. AAS88571
MASPPAHRSSKAADEELPKASSTFHPSLWGSFFLTYQPPTAPQRANMKERAEVLRERVRKVLKGSTTDQLPETVNLILTLQRLGLGYYYENEIDKLLHQIYSNSDYNVKDLNLVSQRFYLLRKNGYDVPSDVFLSFKTEEGGFACAAADTRSLLSLYNAAYLRKHGEEVLDEAISSTRLRLQDLLGRLLPESPFAKEVSSSLRTPLFRRVGILEARNYIPIYETEATRNEAVLELAKLNFNLQQLDFCEELKHCSAWWNEMIAKSKLTFVRDRIVEEYFWMNGACYDPPYSLSRIILTKITGLITIIDDMFDTHGTTEDCMKFAEAFGRWDESAIHLLPEYMKDFYILMLETFQSFEDALGPEKSYRVLYLKQAMERLVELYSKEIKWRDDDYVPTMSEHLQVSAETIATIALTCSAYAGMGDMSIRKETFEWALSFPQFIRTFGSFVRLSNDVVSTKREQTKDHSPSTVHCYMKEHGTTMDDACEKIKELIEDSWKDMLEQSLALKGLPKVVPQLVFDFSRTTDNMYRDRDALTSSEALKEMIQLLFVEPIPE

SEQ ID NO: 515 - protein, 547 aa, Zea mays
  mexicana (E)-beta-caryophyllene synthase
  ref <308>: DATABASE ACCESSION NUMBER: Genbank Acc. No. ABY79212
MAADEARSVSRLHSEEDMHGKHHSTLWGDFFLHHVPCRPGQYLIMKDNVEIMKEEVKKMLLDVGSSDLSHKLDCIDTLERLGLDYHYTKEIDELMCNVFEARDQDLDLTTTSQLFYLLRKHGYHISSDVFLKFRDDKGDIVTNDARCLLRMYEAAHVRVNGEEILDNILIHTKRQLQCIVDDLEPTLQEEVRYALETPLFRRLNRVQARQFISTYEKSTTRNNMLLEFSKLDFNILLTLYCEELKDLTLWWKEFQAQANTTIYARDRMVEMHFWMMGVFFEPQYSYSRKMLTQLFMIVSVLDDLYDSHCTTEEGNAFTAALQRWDEEGVEQCPTYLRTLYTNIRATVKAIEEDLNLQNNKHAKLVKGLIIDMAMCYNAETEWRDKKYVPATVDEHLKISARSSGCMHLVSQGFISMGDVATSEALEWASTYPKIVRAVCIIARLANDIMSYKREASNNTMVSTVQTCAKEYGTTTVEQAIEKIRELIEEAWMDITHECLRQPQPMALLERAVNLARTMDFLYKDVDGYTDSRSIKGILDSLYVHLID

SEQ ID NO: 516 - protein, 547 aa, Zea mays
  parviglumis (E)-beta-caryophyllene synthase
  ref <308>: DATABASE ACCESSION NUMBER: Genbank Acc. No. ABY79213
MAADEARSVSRLHSEEDMHGKHHSTLWGDFFLHHVPCRPGQYLIMKDNVEIMKEEVKKMLLDVGSSDLSHKLDCIDTLERLGLDYHYTKEIDELMCNVFEARDQDLDLTTTSQLFYLLRKHGYHISSDVFLKFRDDKGDIVTNDARCLLRMYEAAHVRVNGEEILDNILIHTKRQLQCIVDDLEPTLQEEVRYALETPLFRRLNRVQARQFISTYEKSTTRNNMLLEFSKLDFNILLTLYCEELKDLTLWWKEFQAQANTTIYARDRMVEMHFWMMGVFFEPQYSYSRKMLTQLFMIVSVLDDLYDSHCTTEEGNAFTAALQRWDEEGVEQCPTYLRTLYTNIRATIKAIEEDLNFQNNKHAKLVKGLIIDMAMCYNAETEWRDKKYVPATVDEHLKISARSSGCMHLVSQGFISMGDVATSEALEWASTYPKIVRAVCIIARLANDIMSYKREASNNTMVSTVQTCAKEYGTTTVEQAIEKIRELIEEAWMDITHECLRQPQPKALLERAVNLARTMDFLYKDADGYTDSRSIKGILDSLYVHLID

SEQ ID NO: 517 - protein, 547 aa, Zea perennis
  (E)-beta-caryophyllene synthase
  ref <308>: DATABASE ACCESSION NUMBER: Genbank Acc. No. ABY79214
MAADEARSVSKLHSEEDMHGKHHSTLWGDFFLHHVPCRPGQYLIMKDNVEIMKEEVKKMLLDVGSSDLSHKLDCIDTLERLGLGYHYTKEIDELMCNVFEARDQDLDLTTTSQLFYLLRKHGYHISSDVFLKFRDDKGDIVTDDARCLLRMYEAAHVRVNGEEILDNILSHTKRQLQCIVDDLEPTLQEEVRYALETPLFRRLNRVQARQFISTYEKSTTRNNMLLEFSKLDFNILLTLYCEELKDLTLWWKEFQAQANTAIYARDRMVEMHFWMMGVFFEPQYSYSRKMLTQLFMIVSVLDDLYDSHCTTEEGNTFTAALQRWDEEGVEQCPTYLRTLYTNIRATVKAIEEDLNLQNNKHAKLVKGLIIDMAMCYNAETEWRDKKYVPATVDEHLKISARSSGCMHLVSQGFISMGDVATSETLEWASTYPKIVRAVCIIARLANDIMSYKREASNNTMVSTVQTCAKEYGTTTVEQAIEKIRELIEEAWMDVTHECLRQPQPKALLERAVNLARTMDFLYKDVDGYTDSRSIKGILDSLYVHLID

SEQ ID NO: 518 - protein, 550 aa, Zingiber officinale
  germacrene D synthase
  ref <308>: DATABASE ACCESSION NUMBER: Genbank Acc. No. AAX40665
MENQSLTFVGDEEAKVRKSTKFHPSIWGDYFIQNSSLSHAEESTQRMIKRVEELKVQVKSMFKDTSDILQLMNLIDSIQMLGLDYHFENEIDKALRLINEVDDKSYGLYETSLRFRLLRQHGNHVSTDIFNKFKGDNGSFISSLNGDAKGLLSLYNASYLGTHGETILDEAKSFAKPQLISLLSELEQSLAAQVTLFLELPLHKRVKILLVRKYILIYQEGAMRNNVLLEFAKLNFNLLQSLYQEELKKISIWWYDLALAKSLSFTRDRIVECYYWVLTLYFDPQYSHSRLIYSKVISLVSIMDDIYDNYGTLEECRQLTEAIKRWKPQAIDSLPEYLKYFYLKLLKTFEEIGEELEHNEKYRMLYLQDQIKAIAVAYLEEAKWSIERHVPSLDEHLHYSLITSGCSLVPCASYVGMGEVATKEVFDWHSSFPKAVEACCAIGRILNDITSYEREQGRGDNASTVESYMKDHGTNEKDACKKLQEIVEKAWKDLNQESLNQKNISRLIIERLVNFSRSMEEIYMSNDMYTNSGTKMKGNITLVLVEAFPV

SEQ ID NO: 519 - protein, 548 aa, Zingiber zerumbet
  alpha-humulene synthase
  ref <308>: DATABASE ACCESSION NUMBER: Genbank Acc. No. BAG12020
MERQSMALVGDKEEIIRKSFEYHPTVWGDYFIRNYSCLPLEKECMIKRVEELKDRVRNLFEETHDVLQIMILVDSIQLLGLDYHFEKEITAALRLIYEADVENYGLYEVSLRFRLLRQHGYNLSPDVFNKFKDDKGRFLPTLNGDAKGLLNLYNAAYLGTHEETILDEAISFTKCQLESLLGELEQPLAIEVSLFLETPLYRRTRRLLVRKYIPIYQEKVMRNDTILELAKLDFNLLQSLHQEEVKKITIWWNDLALTKSLKFARDRVVECYYWIVAVYFEPQYSRARVITSKAISLMSIMDDIYDNYSTLEESRLLTEAIERWEPQAVDCVPEYLKDFYLKLLKTYKDFEDELEPNEKYRIPYLQEEIKVLSRAYFQEAKWGVERYVPALEEHLLVSLITAGYFAVACASYVGLGEDATKETFEWVASSPKILKSCSIHCRLMDDITSHQREQERDHFASTVESYMKEHGTSAKVACEKLQVMVEQKWKDLNEECLRPTQVARPLIEIILNLSRAMEDIYKHKDTYTNSNTRMKDNVSLIFVESFLI

SEQ ID NO: 520 - protein, 554 aa, Zingiber zerumbet
  beta-eudesmol synthase
  ref <308>: DATABASE ACCESSION NUMBER: Genbank Acc. No. BAG12021
MEKQSLTFDGDEEAKIDRKSSKYHPSIWGDYFIQNSSLTHAKESTQRMIKRVEELKVQVKSMFKDTSDLLQLMNLINSIQMLGLDYHFENEIDEALRLIYEVDDKSYGLYETSLRFQLLRQHGYHVSADIFNKFKDDNGSFISSLNGDAKGLLSLYNVSYLGTHGETILDEAKSFTKPQLVSLMSELEQSLAAQVSLFLELPLCRRNKILLARKYILIYQEDAMRNNVILELAKLNFNLLQSLYQEELKKISIWWNDLAFAKSLSFTRDRVVEGYYWVLTIYFEPQHSRARVICSKVFAFLSIMDDIYDNYGILEECTLLTEAIKRWNPQAIDGLPEYLKDYYLKLLKTFEEFEDELELNEKYRMLYLQDEVKALAISYLQEAKWGIERHVPSLDEHLHNSLISSGSSTVICASFVGMGEVATKEVFDWLSSFPKVVEACCVIGRLLNDIRSHELEQGRDHTASTVESYMKEHDTNVDVACEKLREIVEKAWKDLNNESLNPTKVPRLMIERIVNLSKSNEEIYKYNDTYTNSDTTMKDNISLVLVESCDYFNK

SEQ ID NO: 521 - DNA, 2607 bp, Abies grandis
  abietadiene cyclase
atggccatgccttcctcttcattgtcatcacagattcccactgctgctcatcatctaactgctaacgcacaatccattccgcatttctccacgacgctgaatgctggaagcagtgctagcaaacggagaagcttgtacctacgatggggtaaaggttcaaacaagatcattgcctgtgttggagaaggtggtgcaacctctgttccttatcagtctgctgaaaagaatgattcgctttcttcttctacattggtgaaacgagaatttcctccaggattttggaaggatgatcttatcgattctctaacgtcatctcacaaggttgcagcatcagacgagaagcgtatcgagacattaatatccgagattaagaatatgtttagatgtatgggctatggcgaaacgaatccctctgcatatgacactgcttgggtagcaaggattccagcagttgatggctctgacaaccctcactttcctgagacggttgaatggattcttcaaaatcagttgaaagatgggtcttggggtgaaggattctacttcttggcatatgacagaatactggctacacttgcatgtattattacccttaccctctggcgtactggggagacacaagtacagaaaggtattgaattcttcaggacacaagctggaaagatggaagatgaagctgatagtcataggccaagtggatttgaaatagtatttcctgcaatgctaaaggaagctaaaatcttaggcttggatctgccttacgatttgccattcctgaaacaaatcatcgaaaagcgggaggctaagcttaaaaggattcccactgatgttctctatgcccttccaacaacgttattgtattctttggaaggtttacaagaaatagtagactggcagaaaataatgaaacttcaatccaaggatggatcatttctcagctctccggcatctacagcggctgtattcatgcgtacagggaacaaaaagtgcttggatttcttgaactttgtcttgaagaaattcggaaaccatgtgccttgtcactatccgcttgatctatttgaacgtttgtgggcggttgatacagttgagcggctaggtatcgatcgtcatttcaaagaggagatcaaggaagcattggattatgtttacagccattgggacgaaagaggcattggatgggcgagagagaatcctgttcctgatattgatgatacagccatgggccttcgaatcttgagattacatggatacaatgtatcctcagatgttttaaaaacatttagagatgagaatggggagttcttttgcttcttgggtcaaacacagagaggagttacagacatgttaaacgtcaatcgttgttcacatgtttcatttccgggagaaacgatcatggaagaagcaaaactctgtaccgaaaggtatctgaggaatgctctggaaaatgtggatgcctttgacaaatgggcttttaaaaagaatattcggggagaggtagagtatgcactcaaatatccctggcataagagtatgccaaggttggaggctagaagctatattgaaaactatgggccagatgatgtgtggcttggaaaaactgtatatatgatgccatacatttcgaatgaaaagtatttagaactagcgaaactggacttcaataaggtgcagtctatacaccaaacagagcttcaagatcttcgaaggtggtggaaatcatccggtttcacggatctgaatttcactcgtgagcgtgtgacggaaatatatttctcaccggcatcctttatctttgagcccgagttttctaagtgcagagaggtttatacaaaaacttccaatttcactgttattttagatgatctttatgacgcccatggatctttagacgatcttaagttgttcacagaatcagtcaaaagatgggatctatcactagtggaccaaatgccacaacaaatgaaaatatgttttgtgggtttctacaatacttttaatgatatagcaaaagaaggacgtgagaggcaagggcgcgatgtgctaggctacattcaaaatgtttggaaagtccaacttgaagcttacacgaaagaagcagaatggtctgaagctaaatatgtgccatccttcaatgaatacatagagaatgcgagtgtgtcaatagcattgggaacagtcgttctcattagtgctcttttcactggggaggttcttacagatgaagtactctccaaaattgatcgcgaatctagatttcttcaactcatgggcttaacagggcgtttggtgaatgacaccaaaacttatcaggcagagagaggtcaaggtgaggtggcttctgccatacaatgttatatgaaggaccatcctaaaatctctgaagaagaagctctacaacatgtctatagtgtcatggaaaatgccctcgaagagttgaatagggagtttgtgaataacaaaataccggatatttacaaaagactggtttttgaaactgcaagaataatgcaactcttttatatgcaaggggatggtttgacactatcacatgatatggaaattaaagagcatgtcaaaaattgcctcttccaaccagttgcctag

SEQ ID NO: 522 - DNA, 2451 bp, Abies grandis
  E-alpha-bisabolene synthase
gctggcgtttctgctgtatcaaaggtttccagcttggtttgtgatttgtcgagtaccagcggcttgattcgaagaacggccaatcctcatcccaatgtctggggttatgatcttgtgcattctcttaaatcaccttatattgattctagttacagagaacgcgcggaggtccttgttagcgagattaaagtgatgcttaatccagctattacaggagatggagaatcaatgattactccatctgcttatgacacagcatgggtagcgagggtgcccgccattgatggctctgctcgcccgcaatttccccaaacagttgactggattttgaaaaaccagttaaaagatggttcatggggaattcagtcccactttctgctgtccgaccgtcttcttgccactctttcttgtgttcttgtgctccttaaatggaacgttggggatctgcaagtagagcagggaattgaattcataaagagcaatctggaactagtaaaggatgaaaccgatcaagatagcttggtaacagactttgagatcatatttccttctctgttaagagaagctcaatctctgcgcctcggacttccctacgacctgccttatatacatctgttgcagactaaacggcaggaaagattagcaaaactttcacgggaggaaatctatgcggttccgtcgccattgttgtattctttagagggaatacaagatatagttgaatgggaacgaataatggaagttcaaagtcaggatgggtctttcttaagctcacctgcttctactgcctgcgttttcatgcacacaggagacgcgaaatgccttgaattcttgaacagtgtgatgatcaagtttggaaattttgttccctgcctgtatcctgtggatctgctggaacgcctgttgatcgtagataatattgtacgccttggaatctatagacactttgaaaaggaaatcaaggaagctcttgattatgtttacaggcattggaacgaaagaggaattgggtggggcagactaaatcccatagcagatcttgagaccactgctttgggatttcgattgcttcggctgcataggtacaatgtatctccagccatttttgacaacttcaaagatgccaatgggaaattcatttgctcgaccggtcaattcaacaaagatgtagcaagcatgctgaatctttatagagcttcccagctcgcatttcccggagaaaacattcttgatgaagctaaaagcttcgctactaaatatttgagagaagctcttgagaaaagtgagacttccagtgcatggaacaacaaacaaaacctgagccaagagatcaaatacgcgctgaagacttcttggcatgccagtgttccgagagtggaagcaaagagatactgtcaagtgtatcgcccagattatgcacgcatagcaaaatgcgtttacaagctaccctacgtgaacaatgaaaagtttttagagctgggaaaattagatttcaacattatccagtccatccaccaggaagaaatgaagaatgttaccagctggtttagagattcggggttgccactattcaccttcgctcgggagaggccgctggaattctacttcttagtagcggcggggacctatgaaccccagtatgccaaatgcaggtttctctttacaaaagtggcatgcttgcagactgttctggacgatatgtatgacacttatggaaccctagatgaattgaagctattcactgaagctgtgagaagatgggacgtctcctttacagaaaaccttccagactatatgaaactatgttaccaaatctattatgacatagttcacgaggtggcttgggaggcagagaaggaacaggggcgtgaattggtcagctttttcagaaagggatgggaggattatcttctgggttattatgaagaagctgaatggttagctgctgagtatgtgcctagcttggacgagtacataaagaatggaatcacatctatcggccaacgtatacttctgctgagtggagtgttgataatggatgggcaactcctttcgcaagaggcattagagaaagtagattatccaggaagacgtgttctcacagagctgaatagcctcatttcccgcctggcggatgacacgaagacatataaagctgagaaggctcgtggagaattggcgtccagcattgaatgttacatgaaagaccatcctgaatgtacagaggaagaggctctcgatcacatctatagcattctggagccggcggtgaaggaactgacgagagagtttctgaagcccgacgacgtcccattcgcttgcaagaagatgcttttcgaggagacgggagtgactatggtgatattcaaggatggagatggattcggtgtttccaaattagaagtcaaagatcatatcaaagagtgtctcattgaaccgctgccactgtaa

SEQ ID NO: 523 - DNA, 2018 bp, Abies grandis
  pinene synthase
cagcaatggctctagtttctaccgcaccgttggcttccaaatcatgcctgcacaaatcgttgatcagttctacccatgagcttaaggctctctctagaacaattccagctctaggaatgagtaggcgagggaaatctatcactccttccatcagcatgagctctaccaccgttgtaaccgatgatggtgtacgaagacgcatgggcgatttccattccaacctctgggacgatgatgtcatacagtctttaccaacggcttatgaggaaaaatcgtacctggagcgtgctgagaaactgatcggggaagtaaagaacatgttcaattcgatgtcattagaagatggagagttaatgagtccgctcaatgatctcattcaacgcctttggattgtcgacagccttgaacgtttggggatccatagacatttcaaagatgagataaaatcggcgcttgattatgtttacagttattggggcgaaaatggcatcggatgcgggagggagagtgttgttactgatctgaactcaactgcgttggggcttcgaaccctacgactacacggatacccggtgtcttcagatgttttcaaagctttcaaaggccaaaatgggcagttttcctgctctgaaaatattcagacagatgaagagatcagaggcgttctgaatttattccgggcctccctcattgcctttccaggggagaaaattatggatgaggctgaaatcttctctaccaaatatttaaaagaagccctgcaaaagattccggtctccagtctttcgcgagagatcggggacgttttggaatatggttggcacacatatttgccgcgattggaagcaaggaattacatccaagtctttggacaggacactgagaacacgaagtcatatgtgaagagcaaaaaacttttagaactcgcaaaattggagttcaacatctttcaatccttacaaaagagggagttagaaagtctggtcagatggtggaaagaatcgggttttcctgagatgaccttctgccgacatcgtcacgtggaatactacactttggcttcctgcattgcgttcgagcctcaacattctggattcagactcggctttgccaagacgtgtcatcttatcacggttcttgacgatatgtacgacaccttcggcacagtagacgagctggaactcttcacagcgacaatgaagagatgggatccgtcctcgatagattgccttccagaatatatgaaaggagtgtacatagcggtttacgacaccgtaaatgaaatggctcgagaggcagaggaggctcaaggccgagatacgctcacatatgctcgggaagcttgggaggcttatattgattcgtatatgcaagaagcaaggtggatcgccactggttacctgccctcctttgatgagtactacgagaatgggaaagttagctgtggtcatcgcatatccgcattgcaacccattctgacaatggacatcccctttcctgatcatatcctcaaggaagttgacttcccatcaaagcttaacgacttggcatgtgccatccttcgattacgaggtgatacgcggtgctacaaggcggacagggctcgtggagaagaagcttcctctatatcatgttatatgaaagacaatcctggagtatcagaggaagatgctctcgatcatatcaacgccatgatcagtgacgtaatcaaaggattaaattgggaacttctcaaaccagacatcaatgttcccatctcggcgaagaaacatgcttttgacatcgccagagctttccattacggctacaaataccgagacggctacagcgttgccaacgttgaaacgaagagtttggtcacgagaaccctccttgaatctgtgcctttgtagcaacagctcaaatctatgccctatgctatgtcgggttaaaatatatgtggaaggtagccgttggatgtagaggataagtttgttataatttaataaagttgtaatttaaaaaaaaaaaaaaaaaaa

SEQ ID NO: 524 - DNA, 1785 bp, Abies grandis
  gamma-humulene synthase
tccatggctcagatttctgaatctgtatcaccctctaccgatttgaagagcaccgaatcttccattacctctaatcgacatggaaatatgtgggaggacgatcgcatacagtctctcaactcaccttatggggcacctgcatatcaagaacgcagcgaaaagcttattgaagagatcaaacttttatttttgagtgacatggacgatagctgcaatgatagcgatcgtgatttaatcaaacgtcttgagatcgttgatactgtcgagtgtctgggaattgatcgacattttcaacctgagataaaattagctctggattacgtttacagatgttggaacgaaagaggcatcggagagggatcaagagattccctcaagaaagatctgaacgctacagctttgggattccgggctctccgactccatcgatataacgtatcctcaggtgtcttggagaatttcagagatgataacgggcagttcttctgcggttctacagttgaagaagaaggagcagaagcatataataaacacgtaagatgcatgctgtcattatcgcgagcttcaaacattttatttccgggcgaaaaagtgatggaagaggcgaaggcattcacaacaaattatctaaagaaagttttagcaggacgggaggctacccacgtcgatgaaagccttttgggagaggtgaagtacgcattggagtttccatggcattgcagtgtgcagagatgggaggcaaggagctttatcgaaatatttggacaaattgattcagagcttaagtcgaatttgagcaaaaaaatgttagagttggcgaaattggacttcaatattctgcaatgcacacatcagaaagaactgcagattatctcaaggtggttcgcagactcaagtatagcatccctgaatttctatcggaaatgttacgtcgaattttacttttggatggctgcagccatctccgagccggagttttctggaagcagagttgccttcacaaaaattgctatactgatgacaatgctagatgacctgtacgatactcacggaaccttggaccaactcaaaatctttacagagggagtgagacgatgggatgtttcgttggtagagggcctcccagacttcatgaaaattgcattcgagttctggttaaagacatctaatgaattgattgctgaagctgttaaagcgcaagggcaagatatggcggcctacataagaaaaaatgcatgggagcgataccttgaagcttatctgcaagatgcggaatggatagccactggacatgtccccacctttgatgagtacttgaataatggcacaccaaacactgggatgtgtgtattgaatttgattccgcttctgttaatgggtgaacatttaccaatcgacattctggagcaaatattcttgccctccaggttccaccatctcattgaattggcttccaggctcgtcgatgacgcgagagatttccaggcggagaaggatcatggggatttatcgtgtattgagtgttatttaaaagatcatcctgagtctacagtagaagatgctttaaatcatgttaatggcctccttggcaattgccttctggaaatgaattggaagttcttaaagaagcaggacagtgtgccactctcgtgtaagaagtacagcttccatgtattggcacgaagcatccaattcatgtacaatcaaggcgatggcttctccatttcgaacaaagtgatcaaggatcaagtgcagaaagttcttattgtccccgtgcctatttga

SEQ ID NO: 525 - DNA, 1865 bp, Abies grandis
  delta-selinene synthase
atggctgagatttctgaatcttccatccctcgacgcacagggaatcatcacggaaatgtgtgggacgatgacctcatacactctctcaactcgccctatggggcacctgcatattatgagctccttcaaaagcttattcaggagatcaagcatttacttttgactgaaatggaaatggatgatggcgatcatgatttaatcaaacgtcttcagatcgttgacactttggaatgcctgggaatcgatagacattttgaacacgaaatacaaacagctgctttagattacgtttacagatggtggaacgaaaaaggtatcggggagggatcaagagattccttcagcaaagatctgaacgctacggctttaggatttcgcgctctccgactgcatcgatataacgtatcgtcaggtgtgttgaagaatttcaaggatgaaaacgggaagttcttctgcaactttactggtgaagaaggaagaggagataaacaagtgagaagcatgttgtcgttacttcgagcttcagagatttcgtttcccggagaaaaagtgatggaagaggccaaggcattcacaagagaatatctaaaccaagttttagctggacacggggatgtgactgacgtggatcaaagccttttgagagaggtgaagtacgcattggagtttccatggcattgcagtgtgccgagatgggaggcaaggagctttctcgaaatatatggacacaaccattcgtggctcaagtcgaatatcaaccaaaaaatgttgaagttagccaaattggacttcaatattctgcaatgcaaacatcacaaggagatacagtttattacaaggtggtggagagactcgggtatatcgcagctgaatttctatcgaaagcgacacgtggaatattattcttgggttgttatgtgcatttttgagccagagttctctgaaagtagaattgccttcgccaaaactgctatcctgtgtactgttctagatgacctctatgatacgcacgcaacattgcatgaaatcaaaatcatgacagagggagtgagacgatgggatctttcgttgacagatgacctcccagactacattaaaattgcattccagttcttcttcaatacagtgaatgaattgatagttgaaatcgtgaaacggcaagggcgggatatgacaaccatagttaaagattgctggaagcgatacattgagtcttatctgcaagaagcggaatggatagcaactggacatattcccacttttaacgaatacataaagaacggcatggctagctcagggatgtgtattctaaatttgaatccacttctcttgttggataaacttctccccgacaacattctggagcaaatacattctccatccaagatcctggacctcttagaattgacgggcagaatcgccgatgacttaaaagatttcgaggacgagaaggaacgcggggagatggcttcatctttacagtgttatatgaaagaaaatcctgaatctacagtggaaaatgctttaaatcacataaaaggcatccttaatcgttcccttgaggaatttaattgggagtttatgaagcaggatagtgtcccaatgtgttgcaagaaattcactttcaatataggtcgaggacttcaattcatctacaaatacagagacggcttatacatttctgacaaggaagtaaaggaccagatattcaaaattctagtccaccaagttccaatggaggaatagtgatggtcttggttgtagttgtctattatggtatattgcattgacatttatgcttaaaggtgtttcttaaacgtttagggcggaccgttaaataagttggcaataattaatatctcgag

SEQ ID NO: 526 - DNA, 2007 bp, Actinidia deliciosa
  germacrene-D synthase
gtgaaaactaaaataggccaagtgtgtaggttcatctctagtttttctctttaaattaattcttcaacccagaaaaaaaacatgcaactaccttgtgctcaagctttgccaataccaactgttacaaccaccactagtattgaaccaccacatgtaacgcgtcgctctgcaaattatcatcctagcatttggggagatcatttcctcgcctactcttccgatgctatggaagaagaggttattaacatggaacaacaacaacgacttcatcacctgaaacaaaaggtgagaaaaatgctagaggcagctgctgaacaatcttcacagatgctgaacctcgtcgacaaaatccaacgcttaggcgtgtcttaccattttgaaactgagatcgaaacagctttacggcacatatacaaaacctgtgattaccattttgatgatctccacactgctgctctctcttttcggttacttagacaacaaggatatccagtttcttgtgatatgttcgacaaattcaagaacagcaaaggtgagtttcaagaatccataatcagcgatgtgcaaggaatgttaagtttgtatgaagctacatgtctaaggatacacggagaagatatactagacgaagcactagcttttaccatcactcaacttcggtccgcattgcccaacttaagcactcctttcaaggaacaaatcattcatgctctgaaccagcccatccacaaggggttgacaaggctcaacgcaaggagccacattttattttttgaacagaatgattgccatagcaaagaccttttgaatttcgcaaaattagatttcaacttattacaaaagttgcaccagagggagctatgtgaaatcacaaggtggtggaaagatttgaattttgcaaagacactaccttttgccagagacagaatggtagagtgctacttttggatacttggggtgtactttgagccccaatatctgcttgctaggaggatgctaaccaaggtgattgccatgatttccattatcgatgacatctacgatgtctacggtaccttggaagaacttgttctcttcactgatgcaattgagaggtgggagatcagtgccttggatcaacttccagagtatatgaaactatgttatcaagcacttttggatgtttatagtatgattgatgaagagatggcgaagcaaggaagatcttattgcgtagactatgcaaaatcttcaatgaaaattttggttagagcatacttcgaagaagccaaatggtttcaccaaggatatgttccaactatggaagagtatatgcaagttgcattagtaaccgcgggttacaaaatgcttgcaacctcttcctttgttggcatgggagatttggcaaccaaagaggcctttgattgggtgtcaaatgatcctttaattgttcaagctgcatcagtgataggcagactcaaggatgacattgttggccacaagtttgagcaaaagagagggcacgtggcgtcggctgtcgaatgctacagtaagcaacatggtacaacagaggaagaggctattattgaattggataaacaagttacacattcatggaaagacatcaacgcagagtgcctctgcccaatcaaggtcccaatgcctcttcttgcgcgagttctcaatcttgcacgagtgctttatgttatataccaggatgaagacggatacactcatcctggaaccaaggtcgagaactttgtaacctcagtgcttatcgattctatgccaatcaattagaaaatgtaacaagacactgaagtggaggcataaataaattcaaaagttgatttaaagttggggtagtgaacggggattcttaccattaagagatattcttgctaaaaagcaattaattcaatgcatttccaataaaataatttagccagttgttcttcatcttgttttttttttgtttctctttcctttctaaatataaaattataattaattggcaaaaaaaaaaaa

SEQ ID NO: 527 - DNA, 1885 bp, Antirrhinum majus
  (3S)-(E)-nerolidol synthase
tcttcatcatatttaagcattttatattggcaacaacttgtcaggtgtaccccacgcttgttcactaaataccaatattactaaatttgcaaaattcggaaatatgagtaaccttcatgtaaagaaaactgatcgaatcgcctcaggttttgatgttgcatatttgtctgctgctaataagacacatcaatggagcattgctgatgatattgcatcaactcctggctcccccagactccattaccctatggacttcaatggacaaagtacacgtactccggataatttttcaatggaatatgataaaaaaattgaagaaataaagaacttgttacggtcaaaacgtgaagaagaaccaattgatagattgatgttcgtggatgccatccagagactaggcgtcaaccacaattttgaggagttgattgaaacaattctccgaaactattatgaatcaacaagtgctaatatatgcggattccacactttgcacgacgtttccctattttttcgtctaatgagacaacatggatacgacatttcttcagatgtatttaacaaattcaaaggcgatgatgggaggttccgaggtgaattacaacgagatacacgaggattgatggaattatatgaagcttcacaactaagatttgagggagaatatacacttgatgaagcagagagctttagcagccagaatctcaataaatacttggccgatatggactgcagctcgtgtagactcgttactaacaaactgcagcacccttatcgaaagagcataggaagattgacaacaaggtatgattttagaggcaagaaccaatggggaaaaacattgcacgagcttgctgcaatggatttgcgcatgaggaaatccgaataccaaaaggagttattccaagtttctgagtggtggaaggaactaaggatagctgagaatctgagtctcgcaagaaaccaaccattgaaatggtatacatgttcgatggccattctcatagatgatataactttatcggagcaaagaatcgagctcaccaaatccatcactttcatttacttgatagatgatatttttgatgtttatgggtcaccagaggagctcgttatttttgcagaagccgtaagcaaatgggactatgctgctgtcgaaacgttgccagattacatgaaactgtgttacaagtctcttcttgataccacaaacgagataggatacaaaatttatgagaagtatggatataatccaattgactccctcaaaacaacgtgggcaagtttgtgcaatgcattcctagaggaagctaaatggtttgcctcggggaacctgccaaacgctacgaagtatttggaaaatggcaaggtgagttcaggagtgtatgtggtgatggtccatttgttctttcttttgggactcggcggaacatgtggaagtgcaatccatttaaacgacacatcaaaacttatgtcctctgtagccacaatccttcggctgtgggatgatttgggaagtgctaaggatgagcatcaagatggtaaagatggatcttacatagaatgctacatgaaagaacatataagcttgtcgactgagcaagcacaacaacacgccattgatttgatatcgagcgagtggaaactccttaacaaagaatgtttcaatcttaatcatgtttcgacatcatctatcaaaaaggcggctcttaatactgcgagaatggttcctcttatgtatagctacgatgagaatcaagggctgccaatcctggaggagtatgttaagattatgttgtttgattagacatcgtcgaagcactaccaattaaagaacaactagtttggttgtaccatacttattaaacaacttttccaatagtaaaaa

SEQ ID NO: 528 - DNA, 1644 bp, Arabidopsis thaliana
  (-)-E-beta-caryophylene synthase
atggggagtgaagtcaaccgtccactagctgattttccagcaaatatctgggaagatccattaacttctttctcaaagtctgacctcggaactgagacgttcaaagagaagcatagtacgctaaaggaggcggtgaaggaagcttttatgtcttccaaagcgaatccgatagagaacatcaaattcatcgatgctctatgtcgccttggtgtctcctgtcactttgagaaagatatcgtagaacaattggataagtcatttgattgtcttgattttcctcagatggtaagacaagagggatgcgatttgtacacggttggaataattttccaagttttcaggcaattcggctttaaactttctgccgatgtgtttgagaagttcaaggacgaaaatgggaagttcaaaggacacttggtgacagatgcatacgggatgttaagtttgtacgaagctgcacaatggggcactcacggagaggacattattgacgaagctctcgctttctcacgttctcatttagaagaaatttcgtctcggtctagccctcatctcgcaattcgcatcaagaatgctctaaaacatccataccataaaggcatctctaggatagaaacaagacaatatatctcatactacgaggaggaagagtcgtgcgacccaacattacttgagttcgcaaagatagattttaatttgctgcaaatattacaccgcgaagagcttgcttgcgtcacaaggtggcaccatgaaatggagtttaaatctaaagtaacatacacaaggcataggataacagaggcatacttgtggtcacttggaacatatttcgagcctcaatattctcaagcacgagttataaccactatggcactaatcttattcacagcgcttgatgatatgtatgatgcatatggcacaatggaggaacttgagcttttcactgatgcaatggatgagtggcttcccgttgttcctgatgagataccgatacccgatagcatgaagttcatttacaatgtgacggtagaattctatgataaactcgacgaggaacttgagaaggaaggaaggtcagggtgcggtttccatcttaagaaatcattgcaaaaaacagcaaatggatatatgcaagaagcaaaatggttgaaaaaggattacattgctacatttgatgagtataaagagaatgcaatcttgtcttcaggttattatggcttgatagcgatgacattcgtgagaatgacagatgtcgcaaaacttgatgcttttgaatggttaaactcacatcctaaaattagggtagcttctgagataataagtcgattcacagatgacatttcaagctacgaatttgaacacaaacgggagcatgtagcgactggcattgattgttatatgcagcaatttggtgtttccaaggaaagagctgtggaagtgatgggaaacattgtttcagatgcatggaaggacttgaaccaagagctaatgaggcctcacgtgtttcctttccctcttttgatgcgagttcttaacctttcgcgagtcatcgatgtattctataggtaccaagatgcttacaccaaccccaagctcttgaaggagcacattgtttctttgctcattgaaactatacccatttga

SEQ ID NO: 529 - DNA, 1786 bp, Arabidopsis thaliana
  (E)-beta-ocimene synthase/ myrcene synthase
aaatcagtataaaatatcatagcggagtctaaagaagagttcatccaattatttaactctttagtgtaatcattagcaacgcaaagaaatgcctaaacgacaggctcaacggcgtttcactcgcaagactgactcgaaaacaccatcccagcctctggtatcccgtcgctctgcaaactatcaaccgtctctttggcagcacgaatatctcctctcgctcggtaatacatatgtgaaagaggacaacgtcgagagagttacgttattgaagcaggaagtgagtaaaatgctcaatgaaacggaaggtttactcgaacagctagagctcatcgacactttacaaaggcttggagtttcttaccattttgaacaagaaatcaagaagacactaacgaatgtgcatgttaaaaatgtgcgagcacacaaaaaccggatagatcgaaaccgatggggagatttatacgcgaccgcccttgagttccgactcctaaggcaacatggtttcagtatcgcacaagatgtttttgacggaaatattggagttgatttggatgataaagacatcaagggtattctttcactatacgaagcttcatatctctcgaccagaatcgatactaaattgaaagagagcatatactatacaacaaaacgacttagaaaatttgtggaggtaaataagaatgagaccaaatcttacactcttcgaaggatggttatacatgcgttagagatgccgtaccaccggagagtgggaagactagaagcaagatggtacatagaagtgtacggagagagacacgacatgaaccctatcttgcttgaactcgcgaaacttgattttaatttcgtacaagctatccatcaagacgagctcaaatccctctctagttggtggagcaagacgggattaacaaaacacctcgatttcgttagagatcgaataacggagggttatttctcgagtgttggagtaatgtatgagcccgagtttgcatatcaccgacaaatgcttacaaaggttttcatgctcattacaactatcgacgatatatacgatatttatgggacacttgaggagctccaactattcacgaccatagttgaaaaatgggatgtgaatcgtcttgaagaacttcccaactacatgaagttatgttttctctgcctcgtcaacgaaatcaatcagattggatattttgtactcagagataaagggtttaatgtgattccttacctcaaagaatcttgggcagatatgtgtacaacgtttttgaaagaggcaaagtggtataaaagtggttacaaacctaacttcgaagaatacatgcaaaatggttggatctcaagctcagtccctacaatacttctacacttgttctgtctcttatccgaccaaaccttagacattcttggctcctacaatcactctgtagttcgaagctccgccaccatcctccgtctcgctaacgatctcgccacttcttcggaggaattagcgagaggcgacactatgaaatccgtacaatgtcacatgcatgaaactggagcttcggaggcagagtcacgcgcgtacattcaaggaattatcggtgtggcttgggatgacttaaacatggagaaaaagagttgtaggctacatcaaggtttcctagaagctgcggctaatcttggacgtgtggctcagtgcgtttatcagtacggtgatggccatggctgtcctgacaaggctaagaccgtcaatcatgtccggtccttgctcgtccaccctcttccactcaattaa

SEQ ID NO: 530 - DNA, 1622 bp, Arabidopsis thaliana
  (Z)-gamma-bisabolene synthase
atggaatcccaaacaacgtttaagtatgaaagtcttgcgttcacaaagttgtctcactgtcaatggactgattacttcctctctgttcccatcgatgaatcggaactagatgttattacaagagagattgacatactcaagccggaagttatggagctcctatcttcccagggtgacgatgagacatcgaagaggaaagtgcttttgattcaattgcttcttagtcttggtctcgcatttcattttgaaaatgagatcaaaaatatactagaacatgcttttcgaaagatagatgatataactggtgatgaaaaggacttgtctacaatctccatcatgttccgtgtctttagaacatacggacacaatttaccatcaagtgtattcaagagatttacaggggatgatgggaagtttcagcaatctcttacggaagatgctaaaggaatacttagcttgtatgaagcggcacacttgggaacaacgacagattatatattggacgaagcgttgaagtttacatcgagccacttgaagtctttattggcaggagggacgtgccggcctcatatcttaaggcttataagaaacacactttatttacctcaacgttggaatatggaagcagtaattgcaagggaatacatttcgttctatgaacaagaagaagatcacgataagatgctactcagattagccaagctcaatttcaagttattgcagctgcattacattaaagaactgaaatcttttatcaaatggtggatggagctaggccttacatctaagtggcctagtcaatttagagagaggatcgtggaggcttggctagctggattgatgatgtatttcgaaccacaattttcgggtggaagggttattgcagctaagtttaactacctccttaccattttagatgacgcgtgcgatcattatttctctattcatgagcttacaagactcgtagcttgtgtggaaagatggagtcctgatggcattgacacacttgaagatatatcgcgaagtgtctttaaacttatgttggatgttttcgacgatatcggaaaaggagtgaggtctgaaggaagctcctaccacttgaaggagatgttagaagagctcaatacactcgtgagagcaaatcttgatcttgtcaaatgggcacgaggaattcagactgccgggaaggaagcttacgagtgggtaagatcgagaccaagactaatcaaatctctagctgcaaagggccgtctaatggacgatattactgattttgacagcgacatgagtaatgggtttgctgcaaatgcgatcaactattatatgaagcaatttgtagttaccaaggaagaggctattctcgagtgtcaaagaatgatcgtggacatcaataagaccataaatgaggagctactgaagacaaccagcgtaccaggtcgagtactcaagcaagcacttaattttggacgcttattggaactcctctacaccaagtccgatgatatatacaattgtagtgaaggaaaactgaaggagtatatagtaactctgctcatagatcccatacgtctttgaagacttcgaattacatggtttattgagtggtttattcatgtctacaa

SEQ ID NO: 531 - DNA, 1665 bp, Arabidopsis thaliana
  (Z)-gamma-bisabolene synthase
atggaatcccaaacaaagttcgattatgaaagtcttgcgttcacaaagttgtctcactctcaatggactgattacttcctctctgttcccatcgatgattcggagttagacgctattacaagagagattgacataatcaagcctgaagttaggaagctcctatcttccaaaggtgatgatgagacatcaaagaggaaagtgcttttgatccaatcgcttcttagccttggcctcgcatttcattttgaaaatgaaatcaaagatatattagaagatgcttttcgaaggatagatgatataactggtgatgaaaatgacttgtctacaatctccatcatgttccgcgttttcagaacatacggacacaatttaccatcaagtgtattcaagagatttacaggggatgatgggaagtttgagcgatctctcacggaagatgctaaaggaatacttagcttgtatgaagcggcacacttgggaacaacgacagattatatattggacgaagcgttggagtttacatcgagccacttgaagtctttattggtaggcgggatgtgccggcctcatatcttaaggcttataagaaacacactttatttacctcaacgttggaacatggaagcagtaattgcaagggaatacatttcgttctacgaacaagaagaagatcacgataagatgctactcagattagctaagctcaatttcaagttattgcagctgcattacatcaaagaactgaaaacttttatcaaatggtggatggagctaggccttacatctaagtggccaagtcaatttagagagaggatcgtggaggcttggctagctggattgatgatgtatttcgaaccacaattttctggtggaagggttattgcagctaagtttaactacctccttaccattttagatgacgcttgcgatcactatttctctattcctgagcttacaaggctcgtagattgtgtggaaagatggaatcatgatggcattcacacactagaagatatatcgcgaattatcttcaaacttgcgttggatgttttcgacgatatcggaagaggagtgaggtctaaaggatgttcctactacttgaaggagatgttagaagagctcaagatacttgtgagagcaaaccttgatcttgtcaaatgggcacgaggaaatcagctgcctagcttcgaagaacatgtagaggttggtgggatagcacttaccacatatgcaacgttaatgtactcttttgttggaatgggagaggctgtcgggaaggaagcttatgagtgggtaagatcgagaccaagactaatcaaatctctagctgcaaagggtcgtctgatggacgatataactgatttcgagagcgacatgagtaatgggtttgctgcaaatgcgatcaactattatatgaagcaattcgtagttaccaaagaagaagctattctagagtgtcaaaaaatggtcgtagacatcaataagatagtaaatgaggagctactaaaaacaaccaccgtgccacgtcgagttctcaagcaagccctcaattttggacgcttattggaagtcctctacaccaagtccgatgatatatacaattgtagtgaaggaaaattgaaggagtatatagtcaccttactcatagatcccatacatctttga

SEQ ID NO: 532 - DNA, 2570 bp, Arabidopsis thaliana
  GA1 ent-copalyl diphosphate synthase
cttcttcactaaatacttagacagagaaaacagagctttttaaagccatgtctcttcagtatcatgttctaaactccattccaagtacaacctttctcagttctactaaaacaacaatatcttcttctttccttaccatctcaggatctcctctcaatgtcgctagagacaaatccagaagcggttccatacattgttcaaagcttcgaactcaagaatacattaattctcaagaggttcaacatgatttgcctctaatacatgagtggcaacagcttcaaggagaagatgctcctcagattagtgttggaagtaatagtaatgcattcaaagaagcagtgaagagtgtgaaaacgatcttgagaaacctaacggacggggaaattacgatatcggcttacgatacagcttgggttgcattgatcgatgccggagataaaactccggcgtttccctccgccgtgaaatggatcgccgagaaccaactttccgatggttcttggggagatgcgtatctcttctcttatcatgatcgtctcatcaatacccttgcatgcgtcgttgctctaagatcatggaatctctttcctcatcaatgcaacaaaggaatcacgtttttccgggaaaatattgggaagctagaagacgaaaatgatgagcatatgccaatcggattcgaagtagcattcccatcgttgcttgagatagctcgaggaataaacattgatgtaccgtacgattctccggtcttaaaagatatatacgccaagaaagagctaaagcttacaaggataccaaaagagataatgcacaagataccaacaacattgttgcatagtttggaggggatgcgtgatttagattgggaaaagctcttgaaacttcaatctcaagacggatctttcctcttctctccttcctctaccgcttttgcattcatgcagacccgagacagtaactgcctcgagtatttgcgaaatgccgtcaaacgtttcaatggaggagttcccaatgtctttcccgtggatcttttcgagcacatatggatagtggatcggttacaacgtttagggatatcgagatactttgaagaagagattaaagagtgtcttgactatgtccacagatattggaccgacaatggcatatgttgggctagatgttcccatgtccaagacatcgatgatacagccatggcatttaggctcttaagacaacatggataccaagtgtccgcagatgtattcaagaactttgagaaagagggagagtttttctgctttgtggggcaatcaaaccaagcagtaaccggtatgttcaacctataccgggcatcacaattggcgtttccaagggaagagatattgaaaaacgccaaagagttttcttataattatctgctagaaaaacgggagagagaggagttgattgataagtggattataatgaaagacttacctggcgagattgggtttgcgttagagattccatggtacgcaagcttgcctcgagtagagacgagattctatattgatcaatatggtggagaaaacgacgtttggattggcaagactctttataggatgccatacgtgaacaataatggatatctggaattagcaaaacaagattacaacaattgccaagctcagcatcagctcgaatgggacatattccaaaagtggtatgaagaaaataggttaagtgagtggggtgtgcgcagaagtgagcttctcgagtgttactacttagcggctgcaactatatttgaatcagaaaggtcacatgagagaatggtttgggctaagtcaagtgtattggttaaagccatttcttcttcttttggggaatcctctgactccagaagaagcttctccgatcagtttcatgaatacattgccaatgctcgacgaagtgatcatcactttaatgacaggaacatgagattggaccgaccaggatcggttcaggccagtcggcttgccggagtgttaatcgggactttgaatcaaatgtcttttgaccttttcatgtctcatggccgtgacgttaacaatctcctctatctatcgtggggagattggatggaaaaatggaaactatatggagatgaaggagaaggagagctcatggtgaagatgataattctaatgaagaacaatgacctaactaacttcttcacccacactcacttcgttcgtctcgcggaaatcatcaatcgaatctgtcttcctcgccaatacttaaaggcaaggagaaacgatgagaaggagaagacaataaagagtatggagaaggagatggggaaaatggttgagttagcattgtcggagagtgacacatttcgtgacgtcagcatcacgtttcttgatgtagcaaaagcattttactactttgctttatgtggcgatcatctccaaactcacatctccaaagtcttgtttcaaaaagtctagtaacctcatcatcatcatcgatccattaacaatcagtggatcgatgtatccatagatgcgtgaataatatttcatgtagagaaggagaacaaattagatcatgtagggttatca

SEQ ID NO: 533 - DNA, 1670 bp, Arabidopsis thaliana
  myrcene/ocimene synthase
caccatgtaataagtctcccacagttcagcgtcgttctgcgaactatcagccttctcgttgggaccatcaccatctcctctcggtcgaaaataaatttgcgaaagataaaagggtacgagagagagatttgttgaaggaaaaagtgagaaagatgctcaatgatgagcaaaagacttatcttgaccaattggagttcattgacgatctacaaaaactcggggtttcttatcattttgaagcggaaatcgacaacattttaacatcttcttataaaaaagatagaacaaacatccaggagagtgacctacatgccaccgcactcgagttccgacttttcaggcaacatggtttcaatgtttcagaagatgtattcgatgttttcatggaaaattgtgggaagtttgaccgtgatgatatatatggtttaatatctctttacgaagcatcatatctttcgacaaaattggataaaaacctgcaaatattcatcagaccttttgctacacaacaactcagagactttgttgatactcatagtaatgaagattttgggtcgtgtgacatggtggaaattgtggtccaagcgttggatatgccctactattggcaaatgagaaggctatccaccagatggtacatagatgtgtatggaaaaagacaaaattataagaaccttgtcgtcgttgaatttgccaagattgatttcaacatcgtacaagctattcatcaagaggaactcaaaaacgtttccagctggtggatggagacaggtttaggtaagcaactctactttgcaagagacagaatagtggagaattatttctggacgattggacaaatccaagagcctcaatacggatacgttcgacaaacaatgacgaaaataaatgcactccttactacaattgatgatatctacgatatctatggcactcttgaagaacttcagcttttcactgtcgcgtttgaaaactgggatataaatcgtcttgatgaactccccgagtacatgaggttgtgttttcttgttatatacaatgaagtcaatagcattgcatgtgagattctcagaactaaaaatatcaacgtgatcccattcctcaaaaaatcttggacagatgtatccaaagcgtatttagtagaagcaaagtggtacaaaagtggtcacaaaccaaatttggaagagtacatgcaaaatgctcggatttcaatctcgtccccaacgatatttgttcacttctactgcgtattctccgaccagctctctattcaggtcttggagactttgtcccaacaccaacaaaacgtcgtccgatgctcctcctcagtgttccgtctagccaacgaccttgtaacctcaccggatgaattggcgagaggagacgtctgcaaatccatccaatgttacatgagtgaaactggagcatcagaggataaggcgcgttcgcatgttcgacagatgatcaatgacttgtgggatgaaatgaattatgagaaaatggcacatagctcttcgatactccatcatgattttatggaaacagtgataaatttggcacgcatgtctcaatgcatgtatcaatatggcgatggccatggctctcccgaaaaagccaaaatcgttgatcgtgtcatgtccttactcttcaatccgattcctttagattga

SEQ ID NO: 534 - DNA, 114505 bp, Arabidopsis thaliana
  Similar to Nicotiana 5-epi-aristolochene synthase
gaattccacatgatgtgtttaatatatatcatagtctatgatcgcaagttcgcaacgattctttcttgattgcatgaaactaatttatgggtttttatcgggtaggaatatatataaatatatcaaagttcgttcatgtgatttgcataaatgtcaacatgattgcatataaaatattgttgattaattcttccctcaatatatttttgccagcttcacttcccatttagtccatacggatttgctagctattagtatatggatgaataaacgatactcatgtgcttgttgcaagtgtttgattggttggttacatcaacctaattaactcaatacatatacatatatgtatagtgcttgcaacccatgctctcatgtgttttaatttaaccaactcagcgacatgattttccaaagaatgtcagtttttaattttttaacttcaaatatatttttttgattcgaggacgactttcttatactcgtcgaccaaaacgatggacatctaaaggctatctaatattggcttcactagggatacatgagtccaaagatgcactttctacatttggcatgattgtcaaattagatagccctaatgaaactaacattagtgggctgttagtcgcacttaagaaccaaaacctactggtaaaggagacttggagggtggaaaaggcgggagagagtattaaaatgtttatgaagcattatagaatacctttgtgccaaatatagtatgaggaatagcaacaatctctcctagtgtcaagtgtcaaccaatcaaatcctctattttagacatgaggaattgaagaggttatactattttagaaaacattgggcctaagtagacagcccaacaaagcaagtagaaattgtataaatccacataaaaaaataagaaagaaaactaaaaactgttttttcattagtaattccgtatcaatactattttttgagcgagttgttcatataaatacatgttgtttattgtacttgaagtataattcaaagttcaagcctaaccaagggaatgctcataatttcgtcctaataccacaatgaagagtcacatttatatttatacaaaaaacagatttttccttaattgttgaaccaaataatatatccaaatatctaatacaatagccatgacatgtttattctgttgatatatttattgtttcgatggcgtggccgaacaaattatacaattttaaatccaaagaaaaagtttatataaattgctttcatcatttaagatgtatggtcactcaatttgacccaatggtcagagtttggaacccatttggagatcaacttatgtctaagatttacgtattaattgggaatattacagcatttaccgcaacattcgctaacattcttaaatactattagcatcgatagctgtgtaagtaatcaactgtgtatgactttttttgtctacgaattggtatgatttaaatcaataaaatgttggtttttcctaaagactatagtctatgtaagcatcatcagaaactcaccggcctagcgtcagacctaatattaggaattagggagacaaatttaaaaaaaagcctagagacatcataacctaacatttttgttggatgaatctgaatccactaaccattacagtatcaaatacttggagtctaacgcagagttgacaagaaatgatacctttcttcaattcttttttacaaaaatatcaagtcatctattttatcattattcaatttagaccccatcatctttatattttcctaatgtgggtccttaattaacctcagccaagagtagataaatcacctggcccactgtataaaactataaattaatgtgctgatcgcaattataggattttacgtagcatatgtcagcaaaatgccttgtcgtatcttttttgtttttattcgctttaaatattagttcacgttcaatggtcttttgaacaaaaaaatctctgcttgcaattgtaattttaaattggttagtggaagttaatgtggtatctcacgatacgttcaaaattagggacttcgtacaaaagaaaaatgtagatgttcagtgagatgttactagtccaatgtagatgttcagtgagatgttactagtccaatgtgtaactactacgaatacatattattggtttaatttatggccttttgtttagtaataatccataacctcaattagcaaaatacatcggagatgtttttttagacgttagttttgtaaaaaacaaatctagttgattttacaaaggaaattaggtgagagttctgttttcgaatatatcaatgaggaagttaagagagactagaagtagttgagcaaactttaaaatgaagcttcatcaaaaataaaaacttaataatgacgtatatatccataaaacaagaaggcaagtgtactgttgagagaagtgaatctttcactccaacttttctaaattcttgagctgcttgagtcattgagttttgtagctggcaagggttgtgctggaagtgtctaaaccaggtcgttaggagcatagagacttcaaatttcaaagcaattaatcatcaaataaggaatcaagtatcatcattttcgaatgactcgtccgtctaaagcttcaaatttgctgtagaattggtttcagaatgactccccatcatgacattgtcctcgtaaaactgttgtcgtaagaccaataaacaataaatccgtttgtaaattctatagaaaattgttaaaaaagtttacgataaaatttgaagtaaataacgtatggtctacatttactctcgctgatttagttggcgtatgatcataattaagtctgactatgtattaggagaacccacgtacgttctaaatcatgctctctaacttataattatatacgttatctaacttataagacgaaacgcgacgtaactacataaataaaatgatctttaaacagcatcaaactatttggattttttgtctgaacacacacattctgatatgtgaaacaaaaaacaaaaaaaaaatgacgtaagcttctcacccttagtgcaatgggggagtcactcgtgtagctacatcacgcttgtaaagtagcttcaccgcttcgtgaaaggttatatctgaataatagataatgataaataaaaaagtaatgtatgataattcctccctccctatatatgattagagaaattaaaccaataatatcatatctttctccaatagcattgaagatctccttacctctctctttctctcgctacttatatttatttccctaaatccttggagctaggagacatcgtgccgttttcttatttgaaagacaagagggagatagatggaggtgaaggttagaagagatgagttggtaccctttgtagcaatggctataatggaagcatgcacgattgctcttacgataatggcgaaaacggcgttgacgggagggatgagtccttttgtgttcgttgtttacacaaacgcttttggatctattcttcttcttccattttctttcttatttcacaggaatgagaggtcggtccacgttcagtattttatatcatagtatatatgttagtactaatcaatcttggttcttttctgatctttggtttgtatgatgatattttatacttgcagaacagaacaatctatcttctcttggccactcctcgttcgcgttttctttctaggtttcaccgggtgggtacataatctatctttattaaataatgttttcttaggaagttatcatattgattatatgagtcgcagaccagattcttacgtactaatattattttgcaataacagtaacttcgtggtcctaaaaccaaatcaaaagatgaggtccatgtttcgaaaatctatacgtacatgtatcaaccactaattggttggatgaatattctatggcatggatttgcgacgtcatgcatattcaaaaagatacaaaaccgcgtgccgtttactcggttataaaataaacaactaggcctaatatgttctattattttccacatcctgacgtttctatgtgagcggcgtataccacacaccatgttttatttgtgttaaaatagaaataaaaacttgtgtgacgtatatgttggttcatataatagtttactcacttgtgagaacacacgcatttgcatgcattgaacgtacataaaatgttattcatgcatatgcacatgcactgattatattgtaacattttaaatatgtgaaggatatttatgttccaaaacttggcatttgtgggactacgcttcagctcaccaatagtagtatgtgcaatgggattgcaaatcccgtccttctccttcctgctctctattattctcgggtaagacatctctcatcaccatgtcaaactctccacataaattatatgaatgttttcaaatatatatataataaatatacatgcatgtgtagaaggagcaaattggattggagaaacacgagtacgagggctaaactgatgggaacaatagtctcgttaagcggagcttttgttgaagagttgtacaaaggtccattcataagaccagcttcgtctgcttccccaaatcgttttcttaaatcagtccctaaacttttggtctactacaacctccccgacaattggtttctcggctgtatctttttggccgtcgctgttttttctgtctccctgttcaatgttgttcaggtactcaatcttccattacggaaaccatcgttatccttatgcatgttagttacctttgaggttaatatatatttcttgtttttgcatgtctttggcagacagggacggtaaaaaagtatccacatgtgatgaaagtggcttcgttttacagcatagtcgggacgatccaatgtctactattctcgttatttatggaaagagaccttagtgcatggaagatccaacctaacttcgatctttatctcattatcgccacggtaattaaatctactttttttttttgttaataacatgcatttcactagatttgatcatttgaatccaagtagtgatataacgattacgctagatcaagactcaagactacatgttcagtttacttataattgattgagttttaaaagatcaaatacataaagccatcgattgtaattaacgtttctaatattggtgactataatgatgtgtaaaaaacagggaacattcggaagtgtaatacgaacaagtgtacacgtaaagtgcacccaaatgaaaggaccttattacgtgccattgttcaaaccctttggtatcttttgggcaacactctttggtaccagcttcttcgtcaacagtcttcactacggcaggtccgtgaacaaattcattaatcaatattctaaatactaattagcatattatcacgcatgagtattaagctatatatgttggtgcatatgggtgcagtgtgttaggagcagccatagctggtgtgggatatttcacagtgtcttggggacaattgaaggaaagcgaagaaaaacaaagttcaaatgaagaaagaaaatccatcaaaactattcatcatcgcgatgaagatgaatacaaagttccattacttattaaccaggaagaaagtcctgtatgaattttgtattatatatagaatatgagggtcgcttaaatatatttttggcccctttcttcgttttttatggcgtgaataaggagaaatgcgagtgagagtgttaagtggtcagtgtcgtatgggagattgctgaagtaggctttttggtccgaaaagcaaaacctgcccaatgtatatacatgtctttgaatatctacagctcgcttcttatgtttctatgtaatgaataatctccaattcatggatcaactattgtattcctgccattaaaactaatgtaaatatctttcatattttgttgttcaacatctagtgtaaatagctacattgttgaagttattcaatgcgagaaaagtcgcatataattaaagtcgcgtatgttaaattttataggtttctaacacaaaatgaaatgatactaaaatttgattagtcattttatttatattatttataattctacctaaatttagatgttgaacacacttcttcatgtgcaaaaaaaaaaaaacacttcttcaacggctcttacataatgccacagccgtagtgactaaaagagcattatttgaaatattttttacgtagtaaatgtaaatctcaaagagaaaagtcaatgtatattcgcctcaatatataacgtctatacgctttaaaggtgcaccggcaccgtcatgtaggccaagtttaataacttaaacagattgagactggtctaaaggattaaatacaacaagtcacggggtggaatttgaacacctgagaaaacaaactgacccatttcagtgaatgtcggatgtctcatgtctacatttatcttctattataagcatctaatattttgggttttcatttacacaagaatggtcaatggtgaatgctcgcaaaatctaatttggatattaacaacaaaccggtaagagatcccaaaatctaaacagcttgtaagaataacactcgtctctggctagccttggtttaggaagatcttgagctatcttgattctcttctacaatatcttgaactatttgttcggaataatatgaagtatcttgacttggtttcaagaagcttgaagtctcttgaatgtcttcatcaactgttattggagctgttattgcgggtaaacataaaagaggcttaggtggaatctggagagcctctagacttccctctaacatttcaacaactttgctcattggtggacgatcatatggattggtctgaatacaccacagacccaccaataccattttctttactatcttctcatcttcttcttcggttatttgatctgccaaaaaactcatgatttctcctttctcaagatctttataaatccaatctggaaagtacattgaagtattactggatccagcattttgagctcttcctatgttccttgctccaatcatctcaagaaccaccattccataactatacacatcagacttatgagaaactcctccaaaattctgggagaacacttctggagcaatgtaccctatggtgcctcttgcatgtagcattgaaatgatgctttcattatttttgcaaagcttagcaagaccgaaatccgaaatcttagggcataagtctccatctatgagtatgttctgtggctttatatcgaaatgtacaatccttgatacacaatggctatgcaagtattctaggccatgagacacacctaccgcaatgttgtataacgttttccattccatcttcgccgacatattcttggagatgaacttgtcgagggatccattcggcatcaactcgtaaattatagctttcttcctcccttcataacagaatccaagtagagaaacgatattagcatgagatgtcctactcatgctagctatttcattgatgaagtcttctccatcctcgtttgactccttcaagatcttcactgcaacatctcggctgccatcaggtaacttccctttatagacagttccaaatccccctttcccaagaacattctcaaatgattttgtcatcttcttgacttgtacataactaaatcgtttcaacattaccactgcttccatgttcttctcattcaaatcactctttctcatattatttgctctaacctttcccacaatcacaataatgatcattgtagccaatactgatgaaactcctacaagagaataagccttaaaacttaggtgttatatacatcaaaaatgagtaagatagttgagagtaatttcaccaggtttcttctaaagtgtaccaagtatgagttttaacctcaatggaatatttcctgcaaatgtattacagaaattatttcgattaacaaaaaataaaatgatacattctcccgtaggtcaaagaaaagaaaaacttaccttttgcttctgttccagttttgatgtttcctgcctctgggaccgttgagctattgatgtttcctgcctctgggaccgttgagctagacggacaaaacgtgatgacaaagttggagaagtttggacaagtgaaactgctgttatcaacgtcgtaggcgtaactataagcgcttgggcacacgttattgaatgtccgcgagtagatcgtccgcttgcatattcccggtggtacgaccaccccagaagagagtccgatacagcaaagctctggcaactggtatctctgacaagtggtcatgcaggctattggatggtgcgatccaaggccactactgttcaccattagctccgagggacatgtctcgttcatgtcaataacgcattcaatgcttctgcagtttttgttctcgggggtcacaagcaaagggaggttgtaaccattgaagacgttgacgacataatagtcgacaccgtaagaagcgaggttaaactcgaccactgttgttggatctatggggataccgaggcacttgatttttccggaggtgcagtctcccgtggcacatgagaaaccccctgttgagttggtggagcagagtgtcctaccccagaaacgacctatccatgatgacggcgctttgatggtacgcgtctctcctttctcaagaacaaaaccggttgtttctagtgatctcctatagccgtaggttgcaggccatatggtgtattggcatttgttttctatcgtaaagctccttgacattgctacatataacaaaaaaaaattcaagatatattgcagagattttaaacgtataatataaagagtaggtgaagagtttggtttatacatggacgtggcaatggacgtggtcgggatgaagaaggtggcgatggaggtgcaggtgacgaagctgataattaaacaaaacattactaataatgaatatatatatatatcagagctttattgattctagggcctagtgggaagcacaaagagaagcctataacaaaacaaagtaaacgaaagaactctttattgaatctgaaacttgttgttttattaagacaagacacacacacttacatactgatcttaagtacatatctgaccaaactaaatgttgtgactgttgaaaactgcccaaactaaagttacgactcttacaagcaccttttgctataacacagaaacttaataattaaataacatattaccaaactcaattataaactagcaaggagtacgtaggtgaagagtttggtttatatacctggaggtggagggagcatttgagctgaaggtggaggaaatagatcaggtggtggtggtggagcaccagaacctgtaaattaaacaaaacacctatcatattgcaaatctcagattcataattgcaacggtcgaagatcttggagaattaaagtaccggaacaagcggatagatcagtgttgactccacatcgaaggttgagaccgagagcttgatctgtagtgatgttgaactgagcgagtaaaccaggagtgttgtagatggtgcagagacagctaaaatctttctccatcgcttccttgatcgagttgcaacaatccgtcgacggctttgttgtcgtgttcaagaacctgaagcagggaactatcttgctcacgcactcagtctgtgcttccacctccaccactgtaaccaaaaccgcgaatatcatcatcgccgttgtcatttttctttcttggtaaatggtaatggaaggtcgagctttttttctttgaattacttttaattttgctttagaggttttgtaatattatataattcagtggctcaaaaccaaaacatatgaagtcaaagagataaagccaaaacaagaatataccgaaacttatcgtcgtcttgacttttgataatcgttgaatccaaagaattgttaaccgatcattcaaggaaaaagagaaaaagtctttctctctgttttcattcaataatcaaaagctatcgtaccttacaagttacaaccataaggaagcccaatcactaaaaagtactcccccataatctcaaagcccaatcactaaaagcccatttttattaatctcatcgtttttttttgttttttttttgtgacattgagtaaacaaaatctgggggaagaaaactagaaaagggcaaataaaatgaagattctcttctgaacagaaaaaagagacaaaatatcgtttgtctcttgaaagacaaaaaaaaaagtttgggaaatagaagacaaaaaacatatctctaggtcttactatttatgctctgcacaaatacaaaccccaaaaaatacctgcaaaattgcatagaacatctcaaatatcctcttattcacggtgcccatccctttcttgccagttgccacttgcttccacaaaactctcttataatttactcaaatctaatacaccagttaataggtcaaatgctattcaaattgttataacaatgttctttgcgatgacataattattacaagttacaacaactccattaattacttttactattttttgtcttgacgcagtccgttatacaactggaattctaatcattatcacagctatctacgccctaatataatagaacgggcatgctagtggctactgtagtacatggacagtttaatgccaataattgaaagattattccaaatcaagaaaaagctacgtatacatgacatgtaattacttaatttgaatatattgcaaaaaataaataaatgttcaactattttttgtactcctccatggtttgaagaacggaagaaataaccaacaaaaaagagtatcatccatgtctgtttttttcgtatctaatccaagaaaataaactacctagctactttttgaaatcccaaaaaattattacacattttgttcttttgtcatatgcgtgtaaatgaatgatatcataggatcttcaacaatcaatgttcatcatttaaaccttccatcgccgcaacatctcgatcatgatctcgttccacgtgtcgacaggaccaggtagacaccaatgcaaacaatcattaggaattctctccggtacaccgttcttgaacgggtccgcgtacatgtacggaccaggatgtccgtctggtctcagtaccgacatagccgtcacgtccaacacctctaacctcacctcagccgcagccgccgtatattcctcaatttctattttgcgcatgtccaagtccagaccttctaaaaccttcccttcgtacggcttggtcatgttacatgcgccgagactgtcccaaggccgtccttcaaaatgtgatggcgaaaatgtcgtcaagatcacctcacgaccacttccagcaaccgctctcaacgttgttcttatcgcttttctaaatacatcataaaaccctacctcggtacagttacttgtttcacaagaatgacatcccaaaaccgaaccagactcgtagtaaaccgctggatgcagaaaccaatgtcccacagagactacgaccgtatcaaaacgttctaaatcattgccccatctctcatccacgcggtctatgtgcaatacattgtggtccaagtttcccgatttctctaaaccggccaccaaaaacggggaccagtaaaccgagacagtgacgttgtgtgactcgaaacgccatcttctgaatttattgtcttctccgtttctatagacgagatcagggctagagacggtagagagcaagcataaaagagactcaagctgatttctagccatggaatcaccgataaaagctagatgcttatctctcataagatcaagaaaccggttcgagtcgaatctcggtatatcgcattcgtttggtttccatttccagtaaagataaccggaatcaggtctaccatggcggaaacaattctgaccatccttgattgttccacatgttgaaccattgtagagtggaccaatctcgtctctgacccagttcccttgcgtataatcgcataaaggttcatcttgtatatgatcaaaactctcttggctttcttcttctgcagatttagaaaacaaccctaaagttaaaaaaatccattcagtttttggatatacacaatattgaagaagttgaataattaccttgagaagatgaagagaagctagtgatcacaacgttagctgcagagtcttgaagagaggtgtctttaatggaggagaatggattattaaaacagagtcgaaacagagctattggtataaaagctaagactataaaaactatgatcttcctctgacttggaacattttgttgctcgtttaatcccatttcaggaacatagaacaacttatcttctttttctctcttttattttggctttcgtgtttttgattattgatatggagcttgtttctaagtatatgtcacatcgttttttggttgttgttcttgttttatgtggaagagacgagacgagtggttcaatggttttggtcctttttggaccatggaggtatattttactcaaaatctttattatttgtctatgtcaatgctattatttgtgcttaatttacaatattttccacatgaaaaatatataaataattttccggagttgtaagtaggttttctttactttttttttgttgcgtagagaaattctaaataattgtccaccgcatatgaatatatgcacgattttttttttatttttttttactcaagattctgttcacttttcgttaatgaggttttaaaagtttgttaaggagatttattaatatgtttggactatcatagtatcatcatttggttgctaaaatatattaagattatatcaaattatcaatacaaatttattagtttgtggtggagaaggaagttgtctttgttcagtgagtggccgccagtctgaaattgtacagacgctgatggctttagtctgaatatggtaaatgacgaaattagccttggataatgtgcgtcgatgacattctttctggctttgctcgtgtcagggtataattgtcagtgtacacagatgccgcgatgtggtttgattaagttaattaatcctaatatcctataattagatggtgacacgtaagcaacgtagttcaaaagacttttcttaagcgttatctgaagtgaagtcttaatcattcgaatatttatttatgtctcatgaggaataattaaatcactgttaaatgaagttagtaaagttttagacacttcacacatctttttttaactgttagatgagtgacgttagtaaagtttgacacttttacacaatttttatgatagaaacagtgatgcctgttgtacggcatcaatgatttcatggcatagtcaacgcagagatgattcattttacccaccaacatgtaatcattttactagacggtaaaaacttttagagcaataaaagatacatttgtatttgtagttcaaaataagatttcacagattcacgacgcatgcagtttgtactgaatagtacacttgacctaattatgatcaagtatgggtaaatataacagtgaaatgctagtctacacatatatatcaatttcaatactgaaaaaaaaatgtggatcaaaaacttacatataaatcactaattttaataatctagctgctagtaaaacaagaattttgagatagtaattgtccactacatcataattaatagctgttaaatgtcaataatataaagtggacacaaacattatgtgtagaacgcatgtggaagatagactcaaacaacatgtgatgaaagatgtgttatatagttttgttttgcgatgagtgtttcgacttgttgtcttcatctccgttaacttcggtccattccattcttccatgtgccctcctctttctgatcattcaaattgttacccaaaccaatcatctttgcctaataaaatcatcaataaaattaatggtcaaaacattaaacttaatttttccaaattcgtggtaaaaaaacaaattgtcagatgaccaagattcaaatcatcccactgcgatttcagttaattgttatttaaatttaaatattattatgaaaagaaaaaacaaatctagtaaagatttagaaccaacattcaaagactgacactcaggatttgaaaattaaaagtagtgacaggagataatggtgatgtagtagctcaccagcttccaataatttctcttttgacaaaatataaaatgattagtttaatttatgccagctggatcacttcattttcctcttaatatctagcatcataagcagttaacaaaaagacataaaaataaaataaaataaaataaaagtaaaataaaaataaatctagcataaacatcttattaagtaacaaaaggtctaccagtggataagaatagtattgtatatactttgtgaaaataattgaaatttctgtaaaaaaaaaaaaaacttatatgcaaagctcaagagtcaagagtaagctggtctaaactctaattgggctatattaataaattacgcctggtaatagcttaaatagtgacgacccaggataggtttatatgggcctatatagctctgaacagaagcccatttacggttacagtttgttattaattgtccacgcgccataaaccaagatattttgcaaccgtcactttttcaaaaccgcgatttagaaaccgccggagagttcgttcgccgccatgaaaccagcaagtgctacggtggctaaagtagacagcggaggagaggacgagaaattcgaggtggggaaggtatacgctgtcaagctgaccaccggagatcagttcaatggcatcgtcttggcttatgattctgaacccaacttcgccgttttcgatatcctttttcgaaatcgctactcgcagctcgtagattcttatctctgctacttcgccttcttgatttcatcttcttgtgtttgttttcgcgtattccttgacggattagtgattttacaagaaggcacgaagcctaaacctctggattcgaaatccttacggatggtgaatgtgaattacataacggagatgaagaatctggggagggttaaggaacgtctcgctaaaaatactttggttaatcttgatggactcatagagaaagagaatcatgctattaggtgatagtttttgcaatttgttgtgaaaatctctatgattgtttcgattttatcactgattttgattaatgtattatgcagtaacgtcgagaagattggttttggtgttaccgcagaagggcagatgatctttgacgcgatttctaagacgtaaggatctctttggttctttatattgaatggatgatgatgatgattttaatacaatccagtagtgtttgaaatcttgttaatggtttttgttagttctttgtgtgaagaagataacaatagcttacattgttactgcttttgctactttttgtgaacagatttgtgctttgtttctgttagcaacgagggttggatcagatgcttgcttatataagtaactgtgaatcgtttagtttttgaatctggattcaatttagtgtttgtattgttcttggtttccagaagatgtaagttatttggaactaatatttgcgctatggttgattgtgtcttttgctttgcttcatttgttgctactgtgaaaatgcctgtaaattagcatcatatctcacatctttactagagttttcatacttgtcatggcatagcgtttttattgcttgtggtttttagaagatgcaagctttttgggactatatatttgacgaattgtgtctttagctatgcttcagttgttgctgctatcaagtcacaaatctttactagagtttatttatgttggacacttggactacttgtcatggcattgctgaaagtataagctacaatggagtaaaattgtcaaagaaagtaattatgtagtttttgctaccttggggtgagttacattatataaaactcgacatggtcagaggctacttatgttgtggaccttgagttttccctgttttgcatctaagaaccgtggtgacaaatggttttatgcttatgatgataatcattctattgacttttagcatatactctttttttattcattgttatgtgatgctgcattctccaggcttcctatacgctgggtgaacaaagaaatgctggtaatgggagatgtgtttattcgtagcccttatcattctgattgtgtctatggaggaccccgtatggtcaatgaacgagtaaagcatgtggtaagtgtcaataccaagtaataaatgtaatatttgcgtttcatgtcatatttatacagttctttgttgtgtcacagctggggcaggagagaaagaagttgcaactcagtgacacctgaggatattgaaggagttgttcaatgaacatagagcaatagcgtaagtctcttatccctagaagtaccctagatgtgataccatgtgtaaattcgattcacgagaagaagatttagagatttttgagttgcagagatttaattttggtgttgacattgacaagaacacagagaatgttgttgttacactgatttgagacttgaagctttagtgaatggatggcttggactagttaagacttaggatagtgaaattctaagaccttgatctacaaattgtgaagtcaccgactttttacaaatgggtctttagccttttcccaagtcatagcccaaatcacaacaatgcccatattgaaaatcttattaagcatggtgattagagaaatgactaatttatagctatgatgtggattcaatgtattattgatatatggctcctacaaagtcacattcgcaagcttctttaatgtcaaatctaaaagagtgttacattcctttttgtctttctttaactaaaacaaagctttctcctctctaatccgcttttgctttcgcccccataaaaaaaaaatgcctttcgctttctactttctactttttcatccctttgctgaagtctctgtaaaaaaaattcaatctgaaaaaaaacttacaatcttactttattgctttcagtcactgtgctcaatgctcattggttttcttttatgctcatttcctttctctcacgttcatcctcttttttccttacactctttttacattaatcaaaaagaatcgaaactatattctaactgtgcctggttatatggttcgaacttcggtcacacgtgtgtgcgagtgtccttgtaaacaacatgaataggttgggttaggtaaagagtgattgatgatgaaacaaaggactttgggaaggaggaaacgtcgttgtccactagagatatgaaagtgcaatagtgactaaatcttggtttgtgaccataaacaacaaaaagcaaacccacgattttttttctaaagtaaaatacaaatgagagacgctccctcgagaaactaagttcactcactctctcacgccctacgagtcgggccatgccaccattgattcttctctgttctctcttttcttttattttttattttaatgattccttcactaaatatcatctcatatatcactttataattctttctacttttcaagcatccaaagtttgattattttaatgaatatatagtgtatcttcttctctaaagattaaaggcaaataaagaatccatgtgcaaactttgtttctacatgttctagcatatattccctcgcatttcttttttcttctgtttcgctttaagaacaaatgttaaaatatgcttttgtatgtgcttataattaaatcccattacgtacttgattagtagtcggagaggtgagtaacgtgagtttgatatagattgcatgtaatggtaacatgtacgtagtgtataattatgaagaaatgatcaaaatagctatgaaatacgaatgtataaataggcgatttggttaaaaatatgcgtattatatattctgtttttattcctactaatatccacatgatctacatgcgcttatatacacgatacaaactcatatacatctacatgactacatgtgtatgtaaagtaatactaataaatctgcccattttctataaattaaaatgaatgcaactcctgtcatataatttcattgttttgtctctaccccattcccattagttgtcattatccattattctataagaaaattaatgtatattctgtttgagaaaccaagtgctcgtgaagtgtatgatacaaaaaggtatgcaactaatggcaaacgcgtgtaccaaataacaggacaaggatcaattaagatagtaattaaaagatgattgtctttatacgctgatatataagcttaggtccctttgtgtccccgtgtgtcctaatcaaaacccgcaagagaattaaaataaataaaaagttaataaacaatgataaaggtaatcccccgatgattaatatgtccaaatgtgtgggctggtcattatttatttataattagcatttagcagttgctaatcacctaaccatactctctctttacttttgcatcattttagattaaatagtagtgggtgaagcttctattctttctcttataaagatattttgtatttatattcctgtaatagttatcttgtacgtatttatttataactccatctggttcacgttcaggttgtcatgtcatattgatgctctgctcttacaacataccatttatattcataattcatgtcatgaattttacaaaaccatgccaaccttttgtaaaaggaaagaaaaagttaataaatagtgactagtacgagagtaaaagcagtaacacatttccttacgtacatttgagtggaatcaaaatggtaacagtgcatgtttgatatttggatttaaaatttgtttatgtcaatattatcagtgtatggttgaaaaatgggaaaagtgaggtaaaccaaaataataaataaacagaagaggagcgtcatgaggatttatagaaagtagataacgttgtaatccgatagataagtaaatgattagtataaagcatatgactatgagacgagtgattagttcattggagggtgaacaaataatgtcgtcgatggaaaataaataaatcacattactaaactaatcaactagaattatgaggatggagacattttctcgacgtggggtgcacttctgtcggcacaaaccaacttagttataagattaaaacacacttttgtaaaatgttttgttttgcagtaagtttttttctttttctttcacttcttatttccttttttacttgtaaaatcgtgtgcatacatatataaatggatagtcaaagatggtatttttgtgtggctaatgtttgaggggttcgagagagatagaacggtgtagctacgttatggtttcgtggtgagaccactttctctgacatggagacagatcaacatcacatgtatgctactgctcctattaattgttcctctttactaaaatcaagagagaaattaaccactattttttacttcttttgtaatttgtttttttcataatttgattttcttttgtatatttactgttgttaaaataggtatataaaacccttaatcttttgcccaaaaaaacaaaaacaaagaaatgtgtttaattatggcaaaaatgaggaaggttattacattttgaacattaaatacttttttttttcttttggtcttaaacaaatacaattttcttttgtctttttacgttcgtcgttcaataaaacatacactcgatccacaacacacatgttcacatgcttcgtgctcccacaggccacaccaaaatcaaatctcaccactactcatattatcctctcacgtagctattaaccttctccacgaccattattgagttcaatgtactttttccttcatataatagaaacgttttatttataaaattcaacctttcaagaaaccaaaaaaaaatcatatatatacacatacgtgacaccttacacgcatgcaaacgctactaaaacgcaccgtgacaaaactcatttggagtccacgaatacgtagaaatcaaaaacacaaaatttcccgccaaaataaaagatttgaagagaaaacaaacacgtgagacacacgcctccgtcacgtgaagtcacacacaaggaatcaaaaatcttaaaaatccaaacaaaaaaacaaattatatatacttcgcaacttgattttttttttgtttgatgatgaagctgaggaagggtcccatgaactgctgcgatccattaagacaaagagctcagaaaaatctccactcacaaatcttttgcaaacgctcccctgtcttatccatcagtacctgtgtgatgaggactctaatgcaaatactcttctctctctctctcacacacacacactcacatgatcatatcttttctctaacacgtgtgtgttacactcacttactcattttgctttcttgggaatctgcaaagccattaatgatgagcttcgtctctcccaaccaaccaaccaaccccaaaacccaatttttaccctttccataaaagaaattgtaaccaaaactcttattccttccccttggttggaaaactcttaattactttaactcagccaataaacacttttacttttcttcatcactcccttattactatgtacttgttaaaaaatatactctacttaaacagaagagggttttttttcttctaggttttgtttccttggtcctctactttcactccccaaattttaattagaggtagatgtttcatcacctacccatgaatagccacttaattttctccttttacaaggagaagaggatgagaaagaggattcatcacttggccttgttaacgtcgatgatgcccttacactcactcgaagctttgctatcacttttggtgtatttaaccggttattctcgatggccatcgctttcatcagtctatagcatctcactatcttctcctgaaagtcaaatataaccaaaagacattaattagcaatctgttactcccttgttccatctaaacgtgatataacaaatcctactttgctcaatccgtcacaccaagtctcagggctctcgtggggattgacaacagaggatagagaaggtaactcgttcgctacacagagaatcgcggctgcagctatactcgatggccagtactcaagaaagctcgcttctgtactaattggtcatgtgttagaaccaacccaaaaatgtgctacctaaatgacattatggatcatatatcatacaaatattacgtaccttttatgttggagagtataatctctgtagcatgggagataaagaacccgagaaaggtacccgaaggatcgatcttgtaagcaaagaagctaatgaaatcaaacggtgtaaccgatcttagtctccaatctaacacacttagaacaagaagttccattctttttatagtttttgcttcaaataaatacttcactcctgcaacctacattacattatacagagatacataaattaaagtttcttaaaaaaacagagtaaattcagaatgttaaagaaagaatgataatatatgtttacctgaaaatcaaaaagagaaggaacgagaatttcctccatctttgcagctaaagacaagcatgccactgctaaaagttgcattggccaaccactcgtttcctattttacagaaattaaagctgattaatataatcattgattactatatactctattaagtttaattacaaaattaatttaaaatattatatagtagtaggagcgttttaacactatgattacaaagttttcaataaagccgatatatgaagtggaaagtttactgcaaaagtatactattattatgtaaacgtcaatgtaattttttatcgaaaatataaatttcaataaaataattaaaaaacgaaaaaaagttccccagcccgctcctgttctatcgtttacgtacattccaatataagattaatttctactaaattattctataccgattataattttttgctctaataaatttttagtcgttttcatttttttctgaagaaaagtcaataaacaaatcgatccattgaaaaaaaaaaagggaaataaaactgactttttggggttgttatttgtcatatcaatataataaaaaaacagagacaatagaattaactaacgttgacgtttttaaaacatttaccggtaatcgacgagcgtaaagaaaccgatccatatagttaacggcgaggtacgccgttaaaggctgaaagttataatacgcttgtacctgtaaaccaaacaataccacactactgtaaaaaaaaagattctctgcatgtaacgattcgatcagcgtattttagcgtctacacactctccggcggcgtattttagcattgaaaaaaatgagaggtagagaaaaaaagtgaataggctcgccttgagaatccatgcgacggaatcttctctagcggaagcatcgagagatcgagtttgaaatctagagagataatcatgtccaggaacgaagtgacgctcgtcttcgataaaacaagcgatagaatcaccaggccatgaatcaacctcggaagacgagaaatcaaccgttgactcaccggaaaacacaccggagtcttctccacaaaacaaatccatatcgttagagaatgaaacagacatgtgtagataatcactaaaacggtaactcctcattctctccccataaccggagatgaatcaaaccggagctagataaaccggtgagatctagaagaagcgagaagagagaagtgaaatgtgaggtttttgaattttgtgtggagagaagagtgaaggtttaacacattcatttgtttggatatataaacaagaaacagagattttttgaggttttaataattttttatttaaatgtgtttttatttataaaaatggtgttgttgcaaatgaaacagagagacggttaccgtttccgttatgcccgagaaaacgggactgttgtcactgttccatcaatcgagacggggctggtccgttcgttcattgggttttgttttgagtttttttatttgtagtttatgtttgtgttttttgactaacatgcgctaaagtgaaatgcgtaggttaggaacaaggagtggtgtaattacgtaatacgtggcaggttaagacgttgcatgagtgagtacattacagctaatgtacgtttgtttgcatattactcgtgaagagagaaggccgtacgtgtaatgtattaattggtgacgtgtaatgtattacttggtgattagcttaatgggcctggattatggaacattttctgtgatttggaccattttgttggtcgcttagaaagaaacattttttcgtatttaagatttggactttattactattggttaaaaaataaaagcatcgaaaaataaatcaaaattttacagaggttttaaagtcatgacgcttaatcatacgtatatatataagtatttgatttgctaaaatgcaatttttttggttattgtttgctttttatgtgattagatgtaaaactcctgaaccattttaggcacatgacaaatgctcaatagatttgaggccattttagattcaatgatgattttttaatcgaatgtaattaattgatgttttgcattatagtgcaatttttttgctgttttcttgaattaaccgtatgataaatcagttttttttttgtaatatcaagtgagggaagaagattccaaattttaagattggttatctaattatcttgaattataaattagtagtttaattgagattggttaatcagaggaaagcaaacagtggtctggagcgtgtgggaaagagtagtggaagtccttttcgtagaaccggagattttcttcacattcctttttgtatcaatatgtcatatttatttggtcccttcttggtttaattatgccataaaagtgttaaatcattggcccgtttttattaatcactcccgtagttactttctttcacgtgtgccttacaaaatactttgctccttcgatttagattttagactttaattataccattgggatgatctcggtttagattgtagtagatttttcgcttacctctaatatatttaccccttattttagttttcaggtgtattagaaaaaatgtttcatatttttttttttttttaacattgtttcatatttgttttgtatgtgttttctatgcagatttgtataaatttgtcaatattttcatattgataagaattaaaaattatggaagagctaatatataactatcacttgtatgtactatgtaaatagttgacaatgcttacgtagataacgaaattaacattgagaaaattacaattcaacaactacattgtaccatagaaattagaaacaaatgggatactttttgaaatagaagataatatatttttggtatcttcggcggaagaagaccttcttcattatttatttgttatggctaggttgggctactaattcatttctctgtttaggtagacaatatttaaaacatatggcttacattcagatttgcattcacatttacagttaaattaacatttttatcatgcagtatatgtttatttatattaacattaatgaagtcaagaaactgaaatttgaaaggagggaaaatatgcacctcccaacctacaacaatttatcagactgactacattctcgtggtagggttcgtcatttttgttaatgtcttattttcttaaagaaaatcaagacgattcatgggagctattgccttatagtcaatgatcgttgttgaatggttatttcagatctaattatatggtacgtatgatatcactagacatgatcttatactatcatcgtcacattaattgatactactcgttaagaaatgttttttttcgttctcctgtagcatagtcaactcggaccctattgatatactcttgcatatgtaatcataataatgcatttttttttgttatatacaatgatgatcatgagtccatgttgagttactagaaatataatgaatagttaacaagtgggtcgagtcattttcagcaatatatgttttttttctctacattgagttagttttaggaaacatttctagaatcctctttttaaaggagaacttgaaaatgaataatcaaaacattgaaaaatcggtgaactcagatcattgaagctaccaatttcaatggaatgataatgaggcctatataatattcatacactgatcattgatcgattttttcgccagactccaattttatgtataacaacatgaattgtaactttttcacatttttcagtctctaatcaaacatatcaacaagcacttgcatgatgagtgatgaatagtgacatttttcacatacactgtgcacacagtaactaaagatcattgctttctcatttccactttggtcttggttgaagtaattttatttagtttctgaaggttgaattgtttggaaaaaaaaaaaatgatctccaaaacatgttattttgcatggattgaaaaaagcatataaccatagcaaaatagctgttaatataaaaatgtatggttttgagtttcttttgactataatttatagctcagttttcacaatctccataatattgatcacaatctccacaatcaaactttttattattagagtgtatagttaagcaaaatcccaaaaataaaaaacctagctaggaaaatattcctctaaattaatattacacactagttctaaacaatctgatacgagttgccatcgagatttgcacacgaaaaatgttcaaagggacccttttttcatctttaatctttttggactttggtcggcgttggctgattatgactcgctataccacgatttctgtcccttgttacaaataattctattagctagtctcgattctcttttttctttcttcttttgtttaagtaacctccttatctttcttgtttagtggaatacaggctccgatcaaattcagtcacatgtcatcatttctctaagatatatgtttccacgtcaacaattaatttcagttagtttgtttttatgtgtttatataatacgtaataaatacataaactataatttaaacaagatgaggatttaaaccagcccctagtaataatctaacattaaaacaaaaagtaataacataacaacgatacaaaaaaaaaaaaaatataattacaaattttggtattaaaattattttttctatacattaaatatggaaaaaatatttctcataaaaatatatgtaaatatgtaaaaattcaatcatccttatatattatgttaatttcctttagagtttaaggaaatagttttcgatggttcatgtatttctcattttatatcatattatcacttcgtcaaaactatataaaaagttaaatggtacgaaaataattcgtacttaaaacacataataatgggacatacaccacatatcaccaaaaatattaataataatgggacatgcatagaaggaaaaaaaacataaaaactgaggactgttttgatgaaaacaagaagaagcctaaaatggaattcgtaggatattacattgaaaaatatgactgtaataaatttaagaggatatcacttcaaacacttagttaaaaaccgactatagtacatcctattctttgactttatctagttatatttagtatttacatttgtataccgtctatatatgcccaaaacatgtgaaactatttttaatatagaagtgaagatgtgtccccaataattaatgaatcacatatacgtttttcaacctaaatgtgaattatttcgttaattttgggaaatcaagtttttttctgtttccaaagcatatcttataaactcactttttgttttgataatatataggcacctatttgcgaacaaatttttattatgtacacagtacactcaaaagctttatgtagttattatcattgttatagtgcctaagttgctgcttatctaactatccactaagttttttagtttggtctatatcttagctattaactttagtcgagatcatttaactactatggcggcttgacagactgaggctattctttaatgaaaaactctataatgtaaaattctttttcttagtcatatagaattatagatatctatcgtggtttcaaactttcaatctatatagtatataagtgtataagtgacattatctaaacatgtttatatcctcaaagttgtaaagttactaaacttccgaaaagatgatagaaatagcaaccagaaaaactatattgtattgacttttgactgactttagaactcaatagtgtaggccaactcaacctaacattaaatatttatgaagactaattaacaacaatcatagggagcctattaaaatgttaaagtcttgcgcatgtttgactatataatactaacgtatagttgcatttatttcaatgatataaatattttatatctcattgtactacttaagttatagattgattattcgttggtgatatttaagaccaaatcctaagacgacatatatatgtaagtgtaacccaaaaaaatctaaaagtcataaaccgtatgattataagtatatataagatacgtattatactacagaaacacacacatgtgtaacggaccaacatggatgaagaaatggtcccattgagaagaagagatctaatgacttcaaatcaagaatggtccattttccaaaatagacacgtaaatatatacaaagcttaatccccatccctctattgggtctacacacagcctagcatttttgtattttctgctctgtttttatttttttttaactttacaaattactttttaattcttattatcttcagcttttgttctgtctttttttttattttcctgataaattctcacaacttccattcatgactcgagctgggtcctttgatttgtcacagctaatcaaaacagtattagcacaaaaaagtgtatatcaatatgaccatgaagttcataaaaacatgggacctttgaaagatgttgtctcacatattcatacatatttcaataaaatccattacgtacgattccatataaattattggtcagtcatgctaaatgtaagcaagcaaacatatcatttatggtgttacatcaagttatgacagagtatgattgaggccagaaagtaacttatgggtctaatggatcgtattccaaagtaatgggctttttattaaggccgtaagaggcccatttatgtgatttctttgaagtcgctttgtttgcaagttgcgactactcagtttcttctccggcgaagaagaggataacgaaaagaaaacacatagctatgaacggagcttcgctctgcaactccgttttgcttcattctcattctctctctcgttttcagtcatcctcttcttcttgttctgtgtatctgatttcttctgcgcgtactacgtctaagtatatctcaatttctcatagaattcgacagagctttcgagaagttattgaaaaaaggagtaatgggttttgttcattcgctgtaaacaagcgtagaagtggcgattccgttattgtggagtcagacgatgatgatgaagaagatgatgaagattggggtgaatttgatggagaagatgaaggagaagaagaagaagaagatgaaggagagttcttaccaatggataagatgaagaaatggttagagaaaaagcctcgtggatttggtttaggtaaaaagtacgaaactttaattgaagataagttgctcgacgaaattgagcaaagttggaaagctcaagctgctaatctcaataagcttaagaatgatcctctcaagtctcaacagcttaagcgtgacgataatctcctcaaaggtttcgtcttttcttcttttttttgttaattgagttatagtttggaatcttatttagctttgttgtgttgtaaaggaactggagaaactcaaattgggtttcgtgttcgtgtgactaatcttcctaagaagaagaatgttcatagagatcttaaggttgcgtttaaagaagtaagtggcgttttgagtataacaccagctgtgtctgggaataagaagactaaggatcctgtgtgtaaaggatttgctcatgttgatttcaaaactgagattgatgcaaacaggtatgagacttgtggtgtttatagttaagtggtaatgaggcaaagttttgatttttttctcttaggtttgtgaaacagttcacgggacagagcttagcatttgggaaggttataaagcaaatcaaatgtcaggttgtggagtttacttctgatgattctgtatcgaaggaagtgtacttagataacggtttcaaggtgcagaagcttccgtattctggtcttgaaggagattctagtgctgatgttgttgaagaagaggttttgttgggttcaggggaagaatcggatgattcagaagaagaggtagatgaaagagaagtggaagacgatgagcggaatcatatctctagtagcatagaatcttctcccattgaaatgacacgtgattcgaataccaagttaaagtttgagaaacaagttgtgaagcgagagataagagaacatgaggaactagagacacctttagtttcattccaggtgaataaatctgaggaagctgcagcggaaacacacttggatgatgaacaatctgaggaagctgtagcagaaacactcttgaatgatgaacttgatggggatgatgaagaagaagttgctgaagacaatcttgaacctctgaacagttcattgtcatcctcagaagaaaatagagtagatagaatccgtaggctagagcaaaagcttctcggtaaagaaaaactcttgggtggaggagttggctttgataaaccagaagcaaaacccgctagagttgaaggaaagaagaaggagaaaaagaagaagacaaagattcttgtgaaaggccaagccaaaaaggggacaaagatagaaatccctggatcatcaaagaggtaaagagcatacagcaatttttgctaatcaatgtagaatctctactcaaattgattgatttcgacaattatgattcacaggttaaaggtgaaggagaaggctctattaactggcgtcttagtcaagtatgcggctaaagttgcttcaacctcaaacaatgatgaatgatatcattaacaagtgatcaaattttgatataatctttcatcaactgctagtagtgagccatcttcgatttgtttttataaaagtgttacatgaataggtgataacgttacgtggggaaatgctattttttctttctacatcttcatcaatttgtggagacagcaacgttcataaactacattttcagacttaaaaattgaaacttggcaggtaatacaaaccggattttcactcggcttttaatcggtttcaatttcggattagagaaaactctaaccagagttgtatgaattcattcaataatatgttttttttcttgctgaagtttcattcaataaagttactgttccaacttcaagaaaacttgtaatgaagtgcggttactgcatctatcatatattctagttcaaaacaaatatgagacatatttctgatagagcataggctctcgtgtgacctcctccgagccagataatgtctatcaaattcttgcgtcactggacgaacatccttcagcttcctggtccagttgcttccctgaaagagctcgctaatccgaagcctacatccataagtgtttttttgggtgtataacaacagtattcataggtgactctagaccagaaagcaaacatgctttataaagtttagtggttcatcaaagggaaatccaggtctagctgacacaggagcagtattaaaaactaagaacagaagagtggtatgaagttatcgttacaatgttaagaaaacttgtaatgaagtgaagtttctgcatccatatccaatcagacttgtaaactgcatcaaggtctaggaaatagctacaaacaacgtagctgaatatcgcggattcatcttacgattgaagtatcccattgaaagaggttacaagattaagaacttagaatcatttgaccctgaccaattgtctataattctgaatcaaatcgtttctacttaatgcaatgctactcaaagatcatgatatcaacaaaaccgatatgaaggagccaaagcaacaagctttgattagaaatgaacaaagttctgcgccaagatcaaaagcaacacactaaaacaaagtctacacttctattattcagcgatacattcttgaactaacaaagatccatctctcaacaaaaccaatttagcaatgagaaagaaagagcaagtgtaacaactatgaccctttataaaaccttaatcagctttgtatcttgagctcatacacggaacaaaagcagaaaaatcgaacctttagatgatcactccaacacaactttagcaccaagtgctttcaacttctcaagaatcttctcaccttcttctttagacaaaccagctttcaaaatagcaggagtcttctcaaccaaagctttagcttctttcaaacccaaatcagtaaaactccttaactctttaataatcttaatcttagcagatgcttcaaaagactccaactttatctcaaacactgtcttctccactttagcttcttcactcacaccactttgactcaccatcccaccaccaccaccaacaccaacaccaccaccagctccaggtttcataacagcgactgttggtaactccgtcatacctttcttcttcattataatcgaaccaagctcggagatttctaataatgttagagatgagatctcgtctacgagtctgaatacacgatccgttggtggacttcgatgctctgttggatcaaaagtagctggatcgtaatctgttgggagctttctctgatcgaattcttcttcttcttcatcttcaatcttcgccggttgggtgtaactccggtaaccgccgattcgagaaagaagtgataatctggatgaggtttgagataaatgttgcctgaatctgagaactaagctcatctttaagcacttcttcaaaagctctattatgagttcacagatttgaaaaacagagcaatggtaacgaattggggtttttggttcatctggagaagatgccctaaacagagagacattgggaagagtctctctgatcagataaaatatctaaaagcccaataaaaataggctaggcccgattagtatactttttggcccaaaacgttttcttaaaaacaattgtatttacgtttgtttgttaaattggtaaaaagctacagtaaaagatttctaaaataaatcaaatactagactatcatatatttatagaaaatattagattcataagaaataaaaaaaactatacattaattgacatgtggttcaaccggaccgaacgattgacccaatgacccaaaagagttacagttcaccttctgatccggttttaaaaatattggtaataataactaatagatttaaataataacaaacaaactattatttattcaaataaatcttgtcaataatggaagataaaaattgtccaatataattgaaacttattatcttcaagagcttattactttggtggtgtagtgtgattgatagaaattggtaagttaatcttacaacaataaaatatggaaaaagctaacacaacaaatttgtcgttaggcaattttacaaagaaatagcaaatgatttattgcccttagtaaacatctgacttacaagctctaacgtataaataattccaaattttcaactaaacaattgttgggcccactcgaaagcaggaccctccaaaaataggcgtatgccacttagcgtggagagcacacggtattctttagtaaaaggcgaaagaatagttcgctttgtgctcaccacatggctgcgtgattataatcgaaggaccaaggccttgttttatatgcatctttctcttggaacaaactctcagcttagcgatgtgggactttttctcaaactatttcttttactcttacgcggtcgtttctctctattgttgttttattccacaacaggtaatatctatttcactgctaattacaaatgtttctgactcgagttctaattcttttttttcacactcacaaatcttctttacacaattcaaacatatgttcttaatcttctaattgcgaatcctaatagtctactacgagaatcaatggagttggacttacatggtcaacgtaaatgacagataaaaacctattttactttcacgttgagattcagagatatataccaaccaaaagagtgtttggattacaccaaaacaccgtcgacatttcacaattaggctgtgcttgggttaacaaattgtataccagaaaaagaaaaaatccataacagagagaattacaaaagaaagttctgctgcctacaatcatccggagagaaaagtttcgggttggatctcaaaaaagttatcatagtttcgacccgcatagaggctaacaagaccaaaaagagtgagaagcagctagaggcgagatccgttcattgctaccttgttggaagggacgctatagcctgaagaatcttcttccttggaccctgcattgcatcaatagagtgataccaacttcaagaaatctactaaaagaacagatcaatctcaattgttttcgatcgataagaaacaaaaggaaagtaccattggtatgatgagatcttttagatcactttctttcatctgctttattgtggtcatatccacctgttgtcatattagtcaagtttgttattgaagaacaatgacgaaacagagctcagacaaaaaactaacatggaaaagcaataacgaacctacaatagccaaaatcacaaagctctaagataagaaaataatggtacacttacttcctctctcttaaaggcaagggagtattttccaagtccaattgaatttagaaagccatcaactgatagaggctcgtccacctgttgttccaccaagtagatatacatgccatattataacatatgtataagaagaaggcataaagttttgactatctgatcacaaaggttttatgggtctaagaatgacacgaggtaaatatgaagtactcacccaatgtatagaaagagtaagaagagagaaaattcatccacaaattgagaagaagaataaagatcttacagagaagggactgttctgcataatacttccaagtggaggaagctggctcaatggaggcaatggatgtgggtttgggactggaggaggtaacattggcctggcgaaaggagcaccacttgatggcgcttgaccatttagtacacctctaacaggatatggcgatgctctcatattatcaagcatcctgcttcgtccatgaaaatcttcaatgttactacgtgggggagaacccctggaagaacccatgtagcttctaggattcctaggaggggaaaaaccctgagaagaactcatgtagcttcccatatttctagctggggacagagccctagaattactactgaagcttctggtgctccttggcggtgactgatcccttggagggcccattctccttccagcatttcttggaggtgatctatcccttggactgccagttacccttccagcatttcttggcggtgactgatcccttggagggccaaatctccttccagcatctcttggaggtgatatatcccttggactgccaattatccttccatcacttcttggaggtgatctatcccttgcactgccaatcatccttctaccatttcttggaggggaaggttcccttggaatgccaatgaaacttccagcatttcttggcggcgatcgacccctggaagtatccacaaatctctctggagaccttcgtcgtaaatcttccagagcccatgcagggtgcgaactacttgatgaaatcatctgagaggaaccacgagcagttcttgatgaagataaaggacgatccctcggctcagccatacgaggtcttgtatcaaggctacgaggaggctgctcactccttgagagcttttcacgaagatccatagtgcagccttcatcgctctgagctcgtctctgggcattcttttgcatcagtttgaatcggagatcatttcgactgatctgcaaatcttagtaacaaagaggggtgggtcagaaatcagcaaacatgcgctagtgtgtatccagtaattcacatctataccatttccactgaaacttgcttcccctctttgcctgcataaacaaagaaaaccaaaaactttaatctagtgtaccttgcagcaacaagtaaccaaattcaaaacccataaaaccgaagcatagaacacacaatccatcagttcctccagagttctcaatactcatctattcacaaccccgtgaacaaacaaaaaaggtcctagatatcatgataataagagcaacatcacagattaagaagctcctgacaatcaatatgcagcagtagtacacataagagggaaaaagttaacaccttttactgaccacctcttctccaccataaacagaactatctaacggattccctaatctctctttgacagaccgcttagtcccaactctaggtaactcatacccatcatctatatcacttgcagctcgattcaccacctgcaaaagaaaaacatcaccaaaataagcacttttctagactcaaaaactcattaaatcctacaccaactcatctctataaaacaattctaaagctttcattttccagattcaccaaatcaaactcctttaacacaaaaactgagagatgagaccttcaacgtacctgaccgctacgacctagagttatagtaaccctactccgtctcgaaccttccgacatttgtgaaaaccctaggaaaatcaactggagccaattctaacttacagtgatataaaaccacaaacaacgaaagacaccacaatcacctccttcaaaccctaatcgtacgaagccgaatctactcaaaaatcacagaaagagagtaaacaggttcctgtaaaaaaggtataatagaatataccataagattccgggggaaaattccgatgagattcaaaacgggaaaaaaaaaaacaaatcggaaaagtattaaaatacgtgaagaatcggtggagacgaagaagacgttcgtgacgacggactcttgcttgggctttgaaagtgctgcgcagtgccaaaccaaagagacctgactcatctagtggcttcttcacatgctctcatcaatcgctacgcaaattttacgagataggtttggatttttcattattttcacgtttgaccccatagttcttttataattatcatgtccttttttgggaaattaaatcgaagcgtataataataataaaaaatttaataaaaatgagactgttatatattattaaaatatataggtattaacttatcgatatataaagtagtccaaaaaattgattttagaaccgtaaatttaacaaagctcaaaatgtatgatgaacttaaatggtaaaaaagagcacaagtttgtttgtgggtttatgtgtcctatcaccggataagtcctataacttgactaaacattcactatctgataaacattcactatatatccaaatccaacaattccacccatcttcgtttcctcattttttttttgatttatacacttgcagtttgtgaacatttaaactttctcaaaaatatattgccggaaattggtaaacagttcatcgaaaaaaccgtcagaaatgttttagtttaacaagttttctacatagatatattccgactaatatccaacaaatatttttatgaagtggtaatcaacaagggacgatgataaggagagggatccatcccgtttgtccaagaagagagtcaaagttctaatttgcaatcatacgagggaaaaatatcaaaaaatccaagagaattatctccaatataaaacagagtttttttagacgataatagaggattgaaggtaatagatcctaaagtgatgaacaattgttaacttgttgccgcactaagatcactctcaacagattcaagcacataggtgatgaaacagagctgaatcgatggagactcttcaactagactactaaggtcattatattctttgaaatttccagtggatgattgatgagtcgatcgtaacaatatggatcgagagacgtcacacaaaagatggaatatctatgataagttaaggacacccaagcttcaagggttcacacacaagaacgcgctaaaatgtttgggtaaagaaagctaagaaaatgtataacacgaaatcaaacataggtataggacataaagtaatttatatacaagtagtatatgtgaaatcaaaaactgtagaaaaggaaccaatgtctaaatatgtgtgtatatatatccccatcctttaataaaaaaagaataagatatgaggtaaatcaaactaaaagaattgaagtaagaaaaaaaaaactttatctacggtaagaaccacaagaccaatccgacggttgacaacaagagactaacaattgttgatctcgatgaaccgtcgattctccaggcggcactgaagccaccagtgtctcgctggtgtttagtggtcgacggtggagatgttgtgccgttgaagttagggtttgcaccgtacaagtattggattccttccacgtcatcattggttaagtcaaccttacgtttccctgtcgtgatcgttggatacatgatggattcctcaactgaagaatgtcctaaacctagaagatgaccgatctcgtgaaccgccactgattcaagatcaaccgcagcagttacggagaggaaactgtctaggtctccggagaccacccagttctcatctgcgtctaggtggaatttcccgctgggaggagagaaagcgtgagctaatgttcccaaaacgccgtcgaaaggctctccgtcaccatggtcgccggtgtagaatccgattgtgatgtcagacgtcgagaaagactcggaaagagtgaagtttaacgcggtgacgtcagaccaacgaccaaaagcgcgtgagaacacgctcttgacctcttccgtcaacgggtttttcgggtcgaacgcgtaggtcaagtcacggcggtttctcggccaccgtggctcgcctgggaataacgtgtagcgtttaaccgcgtgcaaatgcgtgcgggagaagttgacctcgaaggtctttcttctcccgccatgcatcaacgaagtaccgttgaccacgtcaggattaccgcaacgcgggatcacgatgtgttgaatggtaagcgcatcaagctcaccggtaacgttaagattgaaattcgtctgatacaattcgacagcggctttgaggatatcatcaaaatcatcggtgaaatttcccgaaaacgtttcagggatgtaaccaaaacgttggaagtattttttgatacggtagagaccatcaacgttttggccgtggtgacaaccggtgaaattggagaaagcgtcccagaaaacacgtgtagtgttacgtagagacggtggtaccgcggtggagttagggaagaaccaggcggaggcaggagaaacaatcaagaaaagcgataaaaacccgaaaacacaaaacctcatggtggttttcggattataggtagccacccaaaaaagaagaaaagaaacaaatggagaaggtaatatttaggattttaggagagaatttgagagagagaagagagattaaagctaaaaaacaggtaaagccgtttagaagatggttttaaatataagatatataaatcgaggtctgcgtttgcgttttgtgttggcgggtgagaggtcgttggaatcgtttgcgtgtcttttgtcaattttctagtttttaattaagaagaaaaatggtgaatgattccaatggaaacatctattggtcttagtcacgttcaaacttatggatgttattggtttgtgatttatatggatttttaatgatttataatattaggaagaatcatttgttattcaattaagattgtttaagattattaaaatttaatgttattagtttctgatttgtaaaatgtaatctaaaatctttataaatttggagttattgaattcatactttagtaaagtcattgaattttttgtgttattcaattaaaacaaaagtattaggattgttaatgatttaaattattgtgttattggtttatgattttatacatttttcttcacaaaataaaatcataaaaagtatcataagaatagagagattgtgaatgatttttagaattgacatggatcatcttcttacccattaaataaaaaccaatctatgtaacgttatgacatctctctaatcttttcaagaaatatcatgaacgtaacttttaaaccctctctctaatctttctatataattatgaactatgtgtaaattttttatatgagaacttaagtacctctaaactttaacaaaagcacagtaaaatattttgggagagtagtacacttttgacatatacaaaacctatgtagaacttttctacgagacaattttataaaatatgaaagaaacaatatttcaaatagataaaatctcaagtaatcatttcaaatctttttaagttaggaagactttacaagattacggaaaagctaatcaaagagattatacaaaactctctaataatcatttaaaatctttgattttatctattatttatattcttttaaaattattaaaactctttcaaagttagaaaccaataacacccgttaaatagaggtcatcaagattaaagaagacttgtgcaactgaaagacttggctccggtttaaaccggtttgatggagctgaaggtggcggagtcaaataaagacgttgaactaagttttgctttttgtttagtttcaagttggagttggtttggtcgggaaagtcatcaaccaatcttcaacttacacgtttttaaggacgtcacaatttggtagcttcctggtaaataatccataatcataggtaaggttggtccatttaaatactttgtttccacttccaagtcattgttgacaaattcttactattgaagaatgaagcagagctaggtaccaaggagataacattgaatatgataagagcatcatataatatattcacacgaagattgtactaaaaacgtggtttactttccctctaactaaaagggtaagcttaaatatataaaccaaaagtatacaaacacaaacagacagagggagagagatagacatacatgttaattaactttgctaacacttagaaggtctctcataattaggaggtaaagaaggacaattctggttcatgtttggatatgggtaaatggtgttataaccaggtaactccattctgtattcacctagaatttgacagaagtcaagcttcccttcctcggtgttgcaccaactcggtaaccgagtctggttagactcaaataacttcagagtgtacgcatctcggatctgaaaatacgaaagaagataaacgttcatgagtaatgttaatggaaagatttgatattgaaaagaaaaaaaaagaaactcacagtgaattcagtgacttgaatgtgatcagcgagagggtcgaatataccagcagctttgtacattgcaaggatgaaagcaacacatgttgtcgatttaccgtcgctataaacccactcatcctgttcagggatggtgagtaactcatcaaatgacattccacgcctcgctgtttcttcaagtatcccatacaaatccagatcctgtacaacggaaacttattagttagcctgtacgtcctaatctgaagaacaatagaaactggatattgtacctcagtaccgagtcgtttattaagtgcctcgttccacatattagcagcatatgcaggttgtacacgagtccacatagacatgacagaaataacctgaaagttcaatgtggcttgttgattaccatgatgatcttaatgatgatagatctttaagaatatcagggattaaaaagtaccaagtgagcatcaaggggaggggggtagttatcgcctagagtgtcgatccagctgaatatcatgttgtgatatccatacggtttgcccaacatactccgtgcatattcccacgcagcagtattgttgaactttgcccggatatcaggatgtagaggaagcaaagctacttgaggatttgaattatccttcaaagtcagctcccaccattcatcccaagggatcacaacaatgatttcttcaccctatggggaaaaagatagtaaaatatctctctttctatccactaacttcaaaatgtttaggtctaccttttcgttctcatgtcctgattcaccaacccaaagattccccaaatcatccttcaaacaaacagcagtatgaccagcaaaagccccagtcacccatttctctaacgtctcaaaaccaccccatctacctcgaatcttcgacaccgccaagaaatcaccagaatgcacatcttctgggttaatcattgaccgccaaggttgagaccgtttctcaaaggtagcacccatatgtttcgtcaagaacgccaaattcgcattctgtccccaagcagtattggagaaaagaggtaacacatcaatcaaagatagcaacgtcccaagcattcctgatggcattagaaacactgaaacgccatgctccttcacctactcatcgaagaaatcaccatgaaaacaaacaccacaaaccctcttaagactataaagaagattaactaaatcaaaaacctacatattccaattcagctttctcttcccaagaatcaaagttcaaagtatgatctctagcagagaaatagtagtcccaagtgatcctgtatggcgttgcaaacacataaagatccatacatgtcaagctatgtgccttggatgtctgcaaaattagttcccaaatgttatcaaacaactcaatttcatccagaataacatacaatttcgaattagcagcaactacacaacagtctcctaattttgaatttgttaccataaaaggaaaaactttacgaaatctgagcatatgagcgttgaaagtataacactttaacattaagaagacaaattaagaacaaattgatgaagaagaaagtgaaattaaccaactttgagatgaagaacaccaccaccaagtccagggacgtcacgatcactaccggtgatatcaagacgagcttcattaccattaaagcaagcacctttccactcaatagatacattattaggagtaactgacccaataaaaaccggcaacaaatccacagcgttgtggaaactgttcaaaacaggccatgagacttgacgaggtagcatcggaagaacatcgttaacgctgaaaggaactttcagggattgacccaggtcaacgcaaaaacctaaccctagacataagaggaagaagagtgatgggttctgagacattcggatccacgaagtgaaattttgagactttgtttcaaggttttggggattttggagaagaagggtttcgtgttgttatggttgaagatgatgatccatttgggatgtttcagttttttttctctctgtgtgttttggattttttggaaaattggactttgggggagataaaatattgagttagttttggatgtggaagaaatcgaccaaactggttttagacttttcttagaaacaagaagtttgaagattctttgctttggtttcatcttccacgtagacacaaacttggtttgtgaatgaatatctccaagaaccggattttaccatctggttcagtttggttcattgttcaattgctcatgacatctgacaaagataattgcaaagtttcacttgaaatgactaatgctatatgatatatagcataatattcacctaagactacaatgattgtatgtatgcacttgatggtcctatccacataaataactacaacaaccaataacaaaatgatgtgacattttctacattcattgtatagataatgttggtccatacaccggaacagtatctctatcgtcgatccagaccataacagtgaaccattgagttgatcaataatgttggagaatttttacattgcgaagatgaaacagtttgagtagcaagggataaacagagtactctcctctactgccattggctgtctaaatggattcaactcaatctgcatttcaaagatacatcgttacattcatatcaatatgattctgaagaaatatataagaatttatctgcaaaacatcattttccaacaaaggttgattggagaagtggacaatagtgtgtctgttttgtgtggccccaaagatgaagaaaaaagagatgtttttgtctccttcaacttcattatatagtatatgtgtcgactctctattctacgtatacagttttgatgagacataagcctgactatatgcaggaggaacccacatatcaataaacatagacttgaaatagttaaataggacaatgaacctataatttagacttacaggtgatgatagaggttgtcctgtgatggttttaatgcaacaagcagccagatgacaagcttcttcacagtaatcagagaatactgctgggacttgtatctcctttatcagttcctgaaattattcacaccaacacatgaatgaataacaaacatatgctctctctgtgtatcctgggaactattggatgtgacattagctactggaaaaacgtacaatagttggcaaccagcttggatatgcagcgatgcctgcgtttggagcaatcactatgtgtggaggaaatgaatcctgccgagatggtcaatcagaaattattacatcttttaggaaacaaacaattcaaggtccacgaaaatggacattacatataagaacagtatagtaaatcattgttttgcccctagactagtagaaaggggtacctttgttatgtcattgtaacgatcatggtaaaaccctctacggagctgtaatgacacagccgaaaccaaagcaggtttgctcccggaattgagaattttgcttgaatttttacattcacattcttttcccatgcaaggggaatatctgcaaagggagatcatttctccatccctgttcatcgagaaagcaaatagagaacgatccatcaaattatgtcaatagttcaacacatacaaagaaaatccagctataatgttgtcactgaatagcttaaagaactctaaagaagagtgattaaaaggaaaaacatatctttactcttcctaactaaaatagaactagtgttatacaaagtaatcaaatagattgtggaatgcaggactcacatatgttgtggaacgtcaggtccaatcaaatctacataaatgcgcagaccagggaagagcgcttgcagctcagcaaaaacaccaagttgcccaagttccttctgaggcccttcagaagctcaaactatcagcaaatcatatatcagaattttacaccatagtggttctgatgattcttttgccaatattaagggactaaactaatataaaggaagtggaggcaattaacaaaaactgcctaacagaacaacgagaacatgatagcaacctcagagaggatacagttcctcaaaaagcagaagagttacagagtgaaacataccaagataatgtatacgaagttcatcacttatttggggagtcaaatttcccatcccaatggcttgaactgcatgatatatcgtaagtggctgaaataaaagcaagctctacgagtcaaaaaaaagaaaacctcaagcattctaatcatacttgaaatcacattactcatcagaaaaactgttattacccagtggagaagtagagctacaggtgaatctagaggtaactttctccactcgaaataatccttccaagtacatagctgtttagttattggagataaaggccctgtgtaatccaaaatcagaactctatagaaacaaactctttcagtaaaaccataaacagagaagtgaaaatgaagtataccacgacatggacaagaagagctcggcaaatgccacccttcaatattaaaactgtcagaaaaagatagtagtcagctcaaccaacaatagcttcaaaccaaaacgtgattctcattaagtaaagagaaaaaataagcaatgaaacctatcaaaagccaaagctccacagttacactcatacatccacattccaacacgatgtaatcccctcttgatgaagaacgagcacctagtctcatgtttttgactaacctaaagaacgaataaaccaaaaacttaaactttgagctgaatttttactaaccaaaaggcatttgattcctcactatcattcaaagtgatgattaacctgaattgtagcttcttctgtaaatgtaaatggaaaatcatttaaaagatcaacacgacgcatttgctcttctaatctctcacattcttccttgtgatagctccaatgcgaaatctacaaacaaaataaagatcaacaaattcaacaaggaacatcctaatttgcttatccacctaactacaagcgaccgatcaaatcatcactgtgaagaagaagaaggcttaagagagagttaaagcagaagttaaaacctgatgagagacggagcaataagctacagcaccacactgaccacacctccgcgtcggtggaccaacacaccgcgtcgcaaaaccacgcgcggcacactccatccgccgtcgacgaccaagacaaccgccgtttcttctcgggacgaaaaaagtattaaagaatctcggtaactcttaaggcccatttttctaatcataaggcccaatgttttcttatcgtaaagcccaattagttcttatcgtaagccacaattttgtttatcgcaaggcccattttgttctcatattaacaatgttaacctagaaaaagtattttgaacaaagaaaaaaaacccctataaaaagtattaaaaaggactgatacaataatgtatataaatatcctaaaagatcttaattttgtaaatttattgttgtatattctaaacccgcaatattagaatgatgatttagtaaacaagaaagacaaaataaataattaattttagctagaaaagatgaaataaacactcatgatttaagccatacaaatcgaagccccttgggttcagcatttctcaccaagtaaataccatcacctctggaaacccatttacgtacttgaccacatcttttattagcggctcctctgtatgctctccatatgttatacacactatgatgccttaagatttattcacgacgatttaatcagatacgcttatggattgccaaagatgatgccatctacttagagaaaaacaatggaaagcgagaacgcatgtataattggaataaaaattaatatggttttcatatatctaaaaaattggacatttgaagccttaataaattatactatgtaaaaatacttgtttatgaatgtaaattataataaattacgatttaattagggaaatattgactatatatttcacccaaatattgaatgtaaattttattttccaatacttttgcacatttaagaaattttcggatgtatttcctaaagaatattaccttttttgttttttaaaccatgcctttttgttttacacgttcataaatgcatgttccatacgcattaccataatttaatttgaacttaattttctctaggaatggtgatgatccactaccactatcattgatttcattccatattcctttgaccgactgaaattacgttggaaatagtatattttgatgaataatttatttactcggaaaaaagaggtcaagttattaatagtaagtacatatacattatcaattaagaattcaattgagttttaaggaaaatcctattaatttgtttggtattcggtatttgttagttctaaggaattgaatttcccgattatacatcattataacgttctcaagttccaaacttgcaacccacattttgtcgatattctcaaatgtgaattcattcaatttcccatagaaaacataaatttgcacttaaagttaacaattgaaatcgtatctaaatgggaatgtttttggcttttagtgttagacttccaaagcgtcaaaaatatttctagaaagagcacaaaaaataagcaacgccactacttttggacaaagtcaacgataacacacatcaaccgcaccagctccataaaagtccatctcacgaaaacgattctagtcaaactacctaaaacacccttatatttacatacaacccaatcccactaacaagggtattttcgtcaatcacaaaatttatcaccgacccgggaagaagaagaagaacagatcaactaatttctgctttcaactccacattaaaccaaaacctccaaaaagaatcatttatttaaattatcttcccgttttaagttcctgagatttttgggaattgtaaatttgaagaaaattaaacaaagacgtgttttcatttttttttttgtttcctttattgatctctctctatctctctaaatgagctaaatcgttaatggctgccatgtttaatcatccatggcctaatttaaccctaatttacttcttcttcatcgtcgttttaccattccaatcactttctcaatttgattctcctcaaaatatcgaaactttcttccccatctcttcactctcccctgttccaccaccgcttcttccaccttcgtcaaacccatctccgccgtcgaataattcatcatcttcggataaaaaaacaatcaccaaagctgtccttataacagcagcaagtactttacttgtagctggagttttcttcttctgcctccaaagatgtatcatcgcacggagacggagagacagagttggaccagtcagagtcgaaaacactttacctccgtatcctcctcctccgatgacgtcggcggcggtgactacgactactttggctagagaaggattcacgaggtttggtggtgtgaaaggtttgattcttgatgagaatggtcttgatgtgttgtattggagaaagctacagagtcagagagaaagaagtgggagtttcaggaaacagatcgtcaccggagaagaagaagacgagaaagaagttatttattacaagaacaagaagaaaacagagcccgttacagagattcctcttcttagaggaagatcatctacttctcacagtgttatccataacgaagatcatcagccgccaccgcaggtgaaacagagtgaaccaacaccaccaccgccaccaccgtcaattgcggtgaaacagagtgcaccaacgccatcgccacctcctccgattaagaagggttcttcaccatcgccaccgccacctccaccggtgaaaaaggttggagctttatcatcatcagcttcgaaaccaccacctgcgccggttagaggagcaagtggaggagagacttcgaaacaagtaaagttgaagcctttacattgggataaagtaaaccctgattccgatcattcaatggtttgggacaaaatcgatcgtggatcattcaggtatatatttatttcgaaagttagggcttttgcttcaatcaattgaaaaaaccctaatttgtttttgtttcttctcagtttcgatggcgatttaatggaagctctgtttggatacgttgccgtggggaagaaatcaccagaacaaggcgatgagaaaaaccctaaatcaacgcaaatattcatacttgatccgagaaagtctcaaaacacagcgattgtgctcaaatcattaggtatgacacgtgaagagcttgttgaatcactcatagaaggaaacgatttcgtgccagacactcttgagaggttagctagaatagctccaacgaaagaagaacaatcagccattcttgaattcgacggtgacacggcaaagcttgctgatgcggagacgtttctgtttcatcttcttaaatccgtgccaaccgcgtttacgagactaaacgcgtttctctttagggctaattattatccagagatggctcatcatagcaaatgtttacaaacgttggatttagcttgtaaagagctgagatctcgtggcttgtttgtgaagcttttggaggcaatacttaaagctggaaacagaatgaacgcgggtaccgcgagaggaaacgctcaagcgtttaatctaaccgcgcttttgaagctttcggatgttaaaagcgttgatgggaagacttctttgcttaactttgtagtggaggaagttgttagatcggaaggaaaacgttgtgttatgaatagaagaagccatagcttaacacgaagcggtagtagtaactacaatggtggtaatagtagtcttcaggttatgtcgaaagaagagcaagagaaagagtacttgaagcttggtttaccagttgttggtggattgagctctgagttttcaaacgtgaagaaagctgcttgtgtggactatgaaacggttgttgcaacttgttctgctcttgcggttagagcgaaagatgcgaaaacggtgattggagaatgtgaagatggagaaggagggaggtttgtgaaaacgatgatgacgtttcttgattcggtagaggaagaggtgaaaatagcgaaaggtgaagagaggaaagtgatggagcttgtgaaacgtacaacggattattatcaagcaggagctgttacaaaggggaagaatccacttcatttgtttgttatcgttagagattttcttgccatggttgataaagtttgcttagatattatgagaaatatgcagaggaggaaggttggtagtccgatatcgccttcttcgcagcggaatgcggtgaaattcccggttttgcctccgaatttcatgtcggacagagcttggagtgattctggtgggtcggattctgatatgtgagagtcaagatttgttatatgtaaatactaaatagtagaagcattttgggtattgattagcattgaaagatgttgaattgtttatagatttatcagtccaaagcattggacttgagtataatttgttccttgtataaataaacaattttgctttaagacctttccatgtttatgaacatgtcttctttaacttcacatagaccttttgtttacgtaagaactaataatactaaattgtttgataattctaaatgtgaaagtgaaccactatatagtgtgaacttggctttattgaattctttttaaaaaaatttctccagagctttagatgtaggagttaatattttcacctaacatagcctcttttttatgtttctctatcaactaacactaaatttgtggatgaagactaaattaacataagtttatctattaactaacaacctaccagtttgatgcttgtaaatatgaaacttcaacgttataaagactatatggtgtgaactttttatccatctttattgacttttaaaattttcttaatttgagtaaacaaaagcagaagctttttaaaggatgcaggagttgatttttgtatatgaacaaaacatatacttctcccttagacgaatttggagctatcattcttggtttcaaactttttaataatttgagctttaaagcaaaatggcaactttatattgatcactagtccacaacactttctctgccttttcctcaatagcaacgcgtagtcaagaagaagaacgtgtttaacatggaccaatcttgattaagataatagtatgatcaaatgcttatataaacacactaaaaaggaatcaaatttaaccattccacaaatcaccaacaaaatttaatgaatcatgtctctgcttctaaagatgttattattttccttattcttcttctatatggcttcaatttctcaatgctcagacccaaccggtggacagtttagcttcaacggttacttgtacaccgatggagttgcggatctaaacccggacggtttgttcaaactcataacttcaaagacacaaggaggagctggtcaagttctttaccagttcccactccagttcaagaactcaccaaacggcactgtttcatccttctccaccactttcgtctttgctatcgtcgcagtacgtaaaacaatcgccggttgtggactttccttcaacatctctcctacaaaaggcttgaattcagttccaaatatcgaccactctaaccattctgtttcggttggatttcataccgctaaaagcgataaaccggatggtgaagatgtcaacctcgttggtatcaatatcgatagctcgaaaatggatagaaattgttcggctggttactacaaagatgatggtagattggtgaatctagatattgcaagtgggaagcctatacaggtttggattgagtataacaactcaactaaacagcttgatgttacaatgcattctattaagatatctaaacctaagattcctctgctttcgatgcggaaagatctttctccatatctacatgagtatatgtacattggctttacttcagtgggaagtccaacttcttctcactacattcttggctggagtttcaacaacaaaggagcagtttccgatataaatctctctcgtcttcctaaagtccccgatgaagatcaagaacggtcgttgagttctaagatcttggcgattagtttaagtatttcaggagttacactagttatcgtcttgattcttggagttatgttgttcttgaagaggaagaagttcttggaagttattgaggactgggaggtgcagtttggtcctcataaattcacttacaaagatctcttcatcgccacgaaaggtttcaagaacagtgaggtacttgggaaaggaggttttggaaaagttttcaaggggatcttaccgctgtctagtataccgatcgcggtgaagaagatttctcatgattcaagacaaggaatgagagagtttttagctgagattgctaccattggtagacttagacatccagatttagttcgtcttcttgggtactgtagacgtaaaggagaactctacttggtgtatgactttatgcccaaaggaagccttgataagtttctttataatcaaccaaatcaaattcttgattggtcacagagattcaatatcatcaaagacgtagcctcgggactctgctacttgcatcagcagtgggttcaagtgattattcacagggatattaagccagcaaatattcttcttgatgaaaacatgaacgcgaagctcggtgattttggacttgcgaagctatgtgaccacgggattgactctcaaacctcgaatgttgcaggtaagtttgtgtttttatgatcattataaacaatcaatcaagatctctggacttattgagggttttgtgttgttactttggacgcaaggtacatttggatatatatcaccggagctgtcgagaacagggaagtcaagcacaagttctgatgtttttgcatttggagtgttcatgttggagattacttgcggaagaagacccattgggccaagaggatcaccaagcgagatggttttgactgattgggtactagactgttgggacagtggagacatactgcaggtagttgatgagaaactagggcacaggtatcttgcggaacaagtaactttggttttgaaactgggattgctttgctcgcatccagtggcagccactagaccaagcatgtcaagcgtgatccaatttttagacggtgtagccactcttcctcataacttgctagaccttgtgaattctcggataatcaatgaaggatttgataccttaggtgtaacgactgagtctatggaagcgagtagtaacgtttccttggtcatgacggaatcgtttctctctagtggacgctaactaatgatcatttatattgtagggttgagattgtatgaaatggttgtttctctgtttccattaattaatagtaacaagtgagaattacatagattgactctaattttaaagaaagagtaaaatcaaatctttgcaaaataactaatcaaaaattaaaacagctagggttgtctccaaatttagacgccttggtctcagaacctggctcgaaccgcaacatggttatatcgcacgcatagctcataactcctgtggtcccttttctacaatccgttagaaacaactgcgatccgaacttcacttctctcttttctttgatatctttgataatccttttcctaatcaaaccgtcaatatcttcttctactgaaaccctaatttgttgagctgtgccagatttgagatcgatatacctattttatatgcaagcaattttttgtcagaattataaacagttttaaataaaatactataagattaatttataatcgaataaattatatataacctttgtgcagatgaggtaacaagattaatagtcttgtaaaacaatgaagcttgaatgtctccttggagacatatataggcattaggaaggttactggggacccttatcaataaatcccaatttgcactgagacgagtttgtgtaatattacgcacagtgaaatccatagaagctatttctatattcggcgcgacaggagtttcttggttcgctagcaaaccacaagctagcaatattgcccaggccaaaattagtaaacctagtaaccggagctcgccggaggtgtctcctgatgttcttcgtgtgtcactcattgtgtcacgattgaaggaagatgattgagaaggtttaataattattctcttgtttagaaatctggttttatatgaatatctaattgataataatttttataggcgatgaatatctcttaataatacacaatttgcggcgatgaatatctagaatcaaataaatatgcaaaaaaagagaggaaaaataacaaaaacgtaaaggggaaaaagaaaggaaacatgtaaaaagtaaagtattggtaaccagaagccgaaaccagaagtcgaattagaaacgaaacaaacattttgtcttcaactatttgtaacagagtcgcttgattctcaaagcattggtaagtctctaaatctctctttttcttgtgtataaagtaatcaagaaaggaagagactttatgccttaaaattcccagagactatgttgcatactttattttaaaagaacggttcaatggcaaaatcgaattttataattttcagaaatatatttatgttgctggctcaatggtattgaatgattctctgtgttgactctccctaaagatgttttcttggcaattgtcatgaatattttggttgtgttatcttatcaagattatggtgttgttgttgtttctggtactgttcttcgtccccgagagcgtcgtatgtcagagaccaaacccaaacggtgtagagttcaacaccagtggaaatatgtacaccagtggatcagcatatataaacaacaatggtctgatcagactcacaaattctacaccacaaacaactggtcaagttttctataatgaccaacttcgattcaagaactcagtgaacggtacagtttcttccttctccaccactttcgttttctctattgagtttcataatggaatatatggaggatatggaattgcctttgttatctgtccaacgagagatctgtctcctacttttcccaccacttaccttggacttttcaataggagcaacatgggagatccaaaaaatcatatagtagctgttgagctcgatactaaagttgaccaacaattcgaggacaaagatgctaaccatgttggcattgatatcaatactttagtttcagatacagttgctttagcgggttattacatggataacggtacatttcgaagtctcttgcttaacagtggacaacctatgcaaatctggattgagtatgacagtaaacagaaacagattaatgtcacacttcatcctctttatgtccctaagccaaagattccacttctttctcttgaaaaggatctttctccatatttgcttgaacttatgtatgttggattcacttcaactacaggggacctaactgcatctcactatatattgggatggacgttcaagatgaatgggactactccagatatagacccctctcgccttcccaaaattcctcgttataatcagccatggatccagagtccaaatgggattttgacaatcagtttaactgtatcaggagtcatcatactcattatcttgagtctcagtttatggcttttcctgaagaggaagaagctattggaagttcttgaggactgggaagttcagtttggtcctcataggtttgctttcaaagatctgcatattgctacaaagggtttcaaggatactgaggttcttggtaaaggaggatttgggaaagtctataaaggaactttaccagtgtccaacgtagagatagcggtgaagatggtttctcatgactcaagacaaggaatgagagagtttattgctgagattgcaaccattgggcgtctcagacatcctaacttagttcggcttcaaggctactgcagacacaaaggtgaactctacttggtgtatgattgtatggccaaaggaagtcttgataagttcctttaccatcaacagactgggaatcttgattggtcacagagattcaagatcatcaaagacgtagcttctggactttattatttgcaccaacaatgggtgcaggtcattatccacagggatattaaaccagccaacatccttcttgacgctaatatgaatgctaaacttggtgactttggtctcgcgaagctctgcgatcatgggactgatcctcagacctctcatgtggcaggtacctttaaatattctacttatttgtattggagacttatagccccaaaaaggaacttctcactcaaaatgttgttacttggaaggtacacttgggtatatttcacctgagctctcaagaacaggaaaggcaagtacaagatcagatgtatttgcgtttggaatagtgatgctagagattgcttgcgggcgaaaacccatattgccacgagcatcacaaagagagatggtactgactgattgggtgctagagtgttgggagaatgaagatatcatgcaggttcttgatcataagattggtcaggaatatgttgaggagcaagcggcacttgttctgaaacttggcttattctgttctcatccagtagcagccatcagaccaaacatgtctagcgtcattcaattattggacagtgtggctcagcttcctcataacttacttgacattgtgcaaactcgagaagttcatcgaggtactgaaatctcaggtgaagcagctgattctccagagtcctgttccatcgctcccttgaccttcactgaatcctttgtctctcatggtcggtaaaagatttaaacctataaggtctcgcaggttcttgatttctattgaaaatgtaagtctgaagctgattctaataaatttgcaagtatataagaagaatgtatattaaaaaaaacagtacttccacgagaaataacaggattgatattcaagtatgttaataacatcatcctcacgtttatagtctacagactctatacacatacattgacacaagactgtataatacttacttctccacaaacgtaatgacttctctatataacaaacatcatttgaaagtttggagatatttgatctttttgctgaaaaatgttggtggagcccttagccttgtgcttcagaagatcagataaaaacaatagtcacctgttacatatcaaagttcgtgaaatgaagactgctacatcatagtactttgtctgaatagccttttgggagaggtccttgaatggggttttcttttggatttagactttgcctccgagttttgacattgcttgcttctgcctgatatcagacaacaatgctcagagatcatacactaatgaaagatatgcaacacggttttcttctcagttaataccttcggtttcgcctgtaaatgtatcctctctacagctcttgtgccaagcctagaaggctgaatttgaagaagaaatattagctatctgaggaattgttaaacttgttatatcagaggataaggtgaacatggtttggcttgctcataaaacatcttacgtccttctgtttctcggctgtcccgttgctttttgatacaacagatgaagaacggtgagagttaggaccttttctctccgtgccatctgattttgcaagcctgttacaagaaaacagatttaggattcaaacaagacacgatgagtaatagaaaactctagatggtgatgcatgtctctgttatacctgacatttttctgaccagttgtacctaacctctgaacagcagttgcctttgcaagaacctggtgtcaaacattggaagtatgaatcgatatttagttataaaccagtagaatctttatcacttggtgaaacactattagactatacctgctttggagctgtatcttgcccatcatcagtagatttcatttggtcgaaactcttctgaaaactcttaaatgcacgtctaacgatgtctttatctcccattcgttccatgatcaacgattttcttgttgttggaacagcagtaggatcggagaccgactgatccacattgagagaaatgggcaatgactttggagcggtttgtttctttctcagtaaagttgagacactttccttctttactgaagagcgagaagtagacattgaacttattgttgaagctgacttagacactcttggagttgaaaaccctggaggttttaaaacaggtgatgctgctttatttgttgcctttgtcatgcttttttccttgcttggttgagttttcctaccacttacaaccttgctcgttaccggtttcttcgtcacctggttagactgtaagacgaagacacagtcatttaaagacattacacataaaactatatgaggaagcttatggtgttttaccttgggagaggctctcatatggttagttcgcacatttttatcagtcttcttgattggattatgatctttctctttcttcgtctccttcattagtgtttcactcatttctccagtatcctttgatggaacatcttcttttacttcttccttcatacaaataacctcttctactttctctttatcctccacttgaacaatctcttcaagtttctcctccaacttcagggtactcagatcatccccagtatcaaccgagcttcgacattccttgaaatccatagtttcttcaagaggcttatggttacatgtctcattcacttcagtaacaatgacggtcacaagcttatcttcttctgaagtactttcaccgttagatccataaccggtactaaactcgatcatcattgactcgtcattgtcactatcgtctgttctttcccggttctgaatattcggcctgaaagatgcattcctctccaaaagtttctcctgctccatgatgatatcagctctcctctcagcaatcttcttgtaatgtgattcgaaataagccttcttctgagctactgatccagcagttgcacacttctccacttcttccaaatacttgtttggagaaaaagatgaaaacttctcccatgaaagtgaatcattctcaaacttaccaaacgaaacagacacttgcagttcttgattcgatgaagccgcggtcgttatctgtttatcaatccacaaacaagtcatataacacctaactaactatgacaaatcaagaaaccacacaaatgcaaaacagatcataggacattgacagtaatgtcaataattaggcacaaacacatcaaaatgacgttggagtagacaaatgggtattaccttatcttcaccactggcaataccaacttccatatccaccattaatgctcaccagaaagaatcctaatccacacaaaaccaaagaaaattcttatcactttcaaacttgaacaaagccagaatcaacttggatttgagctaaaactataccaattttttagcatccaatagtagcttcactgtaaagcagaataattgtagtaaagagaggaaaaacacatataatcttggtttagtaattaatagacactttcaacttcagcatttttcaacctcttggtgagcaaactcagattcttcttaaaaaaatataactaattgagagtgagcttcaataattgaataagcaaagagagagagccaaacactcatcaatgattgacactaagaaaagttatcattacaattccaaaaagaaaaacaaaaaagagaatctagtggcaatcttgtaagattacctgaaaaagtgaagatagcccacacaattgtgttacttccaaaataatgatggacacaaaaagtagtaacaagtgaagattcacaaatacatttcaaagttggaaactttgtgaggaaaaaaacacaaagaggacctatcaagaaaacttataaggagttgttaattttgggtcgaaaaatcccaattacagatttgagtgagagagagaggaagaaaaagaagaagaagagatcagatcagatacaaggatgagaatgaagacaagagacagtgggacctttgtcggaagatggtaagtaagaaagtgttgtactaactaaactattaggcggggacaaaagcgattattaactagtttaactgactaatgttgatagttaaaaatagtcgatattgataacaatcaaagtcgaaggtactttcacattcttttactatatgaatgtcatatacaaacattaaaccaatgcaggtacggacatccttttcacaaatttctaatgtgtgatttaacattttcattatcgttttcaaaaagcatttagaaacgaggaatacgtacatcgtattacttaacaggtcaacccaatccagcccactaacagcccaaatcttgccgtttaagatgagttattttatgtcttgacccaaaaaaaaaagaagatgagttctttgaactttgaagtttgactatggagcagacttaaatatgtgaacagttacatacttacaattgtgtgtccagtttgaaaacttatgtttccgaggagccaagcctttaatgtctccattcttcttcatttatctcacactgcttcatcattgcggacagattcaaataactcttttctttaccatagcaagtaacttctaaccattctaagatgtaatcttatatgtaatctacaatgacatagtttaacaaacttggggtttatttcatgctaacaacacactcgctgcatattcttgaaaagactctaaatacagaaaattgagatcaacataaccatttagggaaagaacacaacaaaatacaaattccaaacaaagaattcttctaactagtcctcatcaatagcttctacaaactcttctctcacacaagtcaatttttacacaaccaacagtcaaaaaataaatcctcaacaatgtatttgtaataacccaaaactacaataacaagtaaaaagaatgttgttgacttacacaaactcttcagaaaaagcttgaatcttctgttaactcagacaaagaagagaacccgaacaaagactgatctttagctctttcaatcttatgctcatataaatcatacggttcccataaatgatccaacggacacggtctcttctcatcaagtctcacccatggcttacctttaccactccaatgcaacaaactcactggtcctttatgcaaagacctacaacttcctcgtacattgtctcctcctaaaccatgttggttccacctatgatcaattgcttcaacgttccctgcgaagacaagaagaaacggaggcaaagaacccaaatcgtagattctcttcttcttctgtatctgcatccaagtttcaagcttttctctgtagtttccttctctccatctaactagatccatcaccatcacacccgtgttgaaataacaaggctttcgacccgagaagaaaccgggtaaagccgggtcggaccagaaacctgaagtgaagtactttgtgaagttagcgtgacaatactccggagctccgatgattcttgaccctgtcaaactcgtgttccaaagctttgttatgtcatcgacgacgatgatgtccgagtctaggtaaatgactctgtctacgcatggatcaagaatatctccgaggtagttccgagcatagttcaatggattctctaaagcttgtctgattgaagaagagataaggttgatcaccgtatcttcccggaaaatgtagactttgaagtttagcgacgggaaagtagatcggacgagttgactcagaacgcgtggactcgccgggtcaaactctgcagcgatgagatggaagaagacgttttctggacacgacgcgtggcggagcattgaatgtacggctgcgattgagccacgtaagtactccgagtcaagcgtcatagctacatgaactaacgaagcgtcgcaagacgacacgaagttttctctgttcaacgattgagacacgcactccttgccgtttctgtactccggagcttccacgaacgaccccagatcaaagccatttccgacggtggcggatacggcggtgagtcttcccggaatcatccgtataccgacggaaaacagtggaataaacaccagaaagatagcaaacgctaaaacggcagatttcatcggaaaacgcaaccgcattttcagaaaacgcggtttctaaagtggattaaagatctgtcttttattccgctagtggattagcattttccagaaactatgaagcttctggaaataaataactcaaagagttaaagaagtgaagaaagcaagaagatgaagcagaagaaggacaagtctctcttttatttggcttaagagagaagtttggtttacacgcgctttcacacaaagcgcgtgaatagttatgtgggtttttagtcgttttgaatgatcaatcccaacgtaattacctattctaactgatgggattaattgaagatttcggtaattaattaaaattttattatctgtgtgttggtgtaccgtaagagtgaaatttaatggtggcttttggaaacttgtgataggtttttgccagctgtgaactcgatggaaacagctggatgatgttttgtcttgaaagtttgtatgggctcgataaaaggagatcgacggctgagactaaacgatgagaagccttttgagtttttgattggtttgatcaaaccctactttctcacgtgcaccacacgcttgtttttggatcagtaaatttcttaaaagtaaatggattggtaaccacaaataatttagatttctagattttaacagattgttatctaaatatcgggaaaaagtgaatctaaaaggtatttttattttgtgttgatcttttatcaaaaaaaaaaaagagtacattgttatgtttaacatttttgttgttggaataacgagtaagaagcgtgtctcactacgaatattctcgtgtgtggtgccacttaataatgttttgttttcgttattgtcgacgttttgtagtgttgagtgtgcgactagcgccactcaataacattatcacaaatatattcatttgcactttagacttaaatccatttcgttagtgttgccgcgtgcagtgtataatcgtttgattcgaatacgtaacgatgaaatctacttatatgtttttatacggagaatacatctccttttatttgtgtatgtgatggaaaatattctgtaatatttaatttaagataacgtcgccatgtttagtgtgactgtgtgagttaactaatgttaggtttcaactgggtctatcggctaccaaatactactaaggtcacaaaggaataaagaaccaaccttgttatgattacttgagttctttgcatttactattagcactacaatttgtccgccatgttcatgccaaaatccccaaccaaacaaattagaagcatgtaaacacttccatctatgtgtttattatttcttaaaattatgaacaaatatagtaaaaaaaaagatgaagatattagtagtaatagatcaagcaaattaaattgaagttaggtggtggaacaatgatgtcgttttggatacggacggagaaggtagatagagagagtcatagagatgcttttctctttattcgatttggtattataaaagtgtttgtttgggtatgaagatattacgatttacgaatttcaaaactatgctttgcgtggcgagtacaacacgggtttattgagttttgtcttcacctctccacttgctttagatttttactacattccgacagctaagtagaagacaaacaaagacagttgtagtaataagcagagctctttgcctttgcttcttgtttctgatgttatcctaactttgaggcaaaccaattttatgcttcattttgttctaaaattagactttcacaaaacaaatatattttcatttttcataggaccaaaaacgtcctcatttatctgtttgttgtctgtgggtaagaaaacaacatttggagacaatagttttcccttcaattaaagaatcgacgttttgataacaatcccgaaaagttgccaaaaatggaatcgagaaactgaaacaaaaaggctttacatttgaattgagttgagaaaactaaaatgacaggagcaagttttagttgcactgtcttggatttattgaaccggattctcctgcatgagtttgcggttataatgaatgttagagaggagatatgtgatggggaataatcgcgactatagtttatggaaagtgttgccctcagttcctttctatgctccaaaagactgcgaattgcaaagaggaaatgcatatctcaggagttgagtggaggaacatatccaagtgcatgtagtccaaaggatatgaagaagaaatgtaagttaactcaagctccgaaacctttttacgtagatatttgtgaaaagctcagatggatccggaacagggctctcctgaaacaaaataaataacgcatagactaagttttggtggtgattggtacacaattgtagttagagatgtaaaaatctcgctttctttatcttggctttagctacataaacctctataaattaatattattgaaaccatgatattttattaattttttttaaaataattttaattcataaaattttagaaagaaatcaattgagacaattttatcgaaatacaattagcgttttggatgttataaattttgtagtttcggatttgaaattttaataattagaagactttgttttcgaaaataaattagacaataaaattacaaacaatatacgtgaattcattttgataggtgaattcagataaacaaactatatacataaattcaaaaatttaattaataatctcaattatcgtatttaatagctagaatattatcaaaatgaaaatgatgcatatttaaaaattaaatacttacaaaaaatcttgactgtttttatgacatagttatagaatatatagtctttgccaaaaaaaaaaaaaggttatagattatactacaacactttaatttaaaaacacattagaccagttattttattcaatacaagtttgagatgggttgtaaggaattttaatcctttcactaaaagcataccttagtatatcaatatgcaaatttatataattattaatgagaaacacgtattacataggaattctaaaaaaaatcttattatcttgtcaaattttattctaatccaatttgagagctaaattttttattaatttataatattattaatttatggaatattaatttacggagtttctattgtagtcaaacaaataataaatcttgtatataacgttgaacttgacctgacacttacgaggaatctttcttgttttcaatgataattgattacatgtttttcgtttgtttaatttattataaaatattaatgatagataaaatgacctatatgtagacatgaagatccatattttacgggatctaaacgcctataagttttgtccttccacagtccaatagaagttcaaaaagaaaatggaggccataacaaaatatggatcttattttaacgttcgtttccttagtcgtttatgttggcggctaaacttgtcctcttcctaccactaccctcttcttaaatcatcactgtcattctctagatttcaatctcccaaaaagttgtgcctagttcgagcaacgacgaatcctacagatgataactcgacgactcgttcatttactccacatccaccaagtctatggggtcatcactttctctctgcttccgtgaatcaaacggtatataagattttatgagaacccttaattagatatactaagggtatatatatagtatattactcattttacttgatagagatcatcaaatctttgcaggaaatggatgatctttggagacagatcgaggcacttaaacctatagtgaatgccatgctgcttccttgtaacggtgctgatgcaaagaagataacttgtttcatccatacgcttgttagtctgggagtctcttaccattttgaggaaaagattgttgagttcctgaaggacgctttcgagaatatcgaggacatgatcatcgattgcaaggaagatgatctctacacggtttctattatattccgggttttcagattatatggtcattacataactccaggtgaggatctttcatctttattacggaactaactgacttggttggtttatgctccgttccgttgtttttaagtggatgtgtgatgtgaacattttgaacatgtttcagagttgcatataactatttcatactacttttttttcttaatatttcatacttgcatgtgtgtagatatattcaacaggtttaaaggagacgatggaaattttaagaaatgtctgaatgatgatgtaagaggtatgctaagcttctatgaagcgtcacactttgggacaacgacagaagatatccttgaagaagcaatgagtttcacacaaaaacacttggagttatttttggtaggcgagaaagccaaacattatccacacatcaccaagctcatacaagctgctctttatatacctcagaatttcaatttggaaatattggtggcaagggaatatattgacttctacgaactagagactgatcacaatgaaatgttactaaagttggccaaactcaactttaggttcctccagctgcaatacattcaagatctgaaaacactaaccacgtatgtatattcatttatatagatgcttcatatatatgtatattttctgaaagttttatcgattaggtgtatgtatgcagatggtggaaggagctagatttagtatctaagataccagtttacttcagagagagattggcagagccttatttctgggcgactgggatttattacgagccacaatattcagctgcacgaatcatgctggccaaatccatcattttagtggacattgtggacaacacttttgatgtatatggtactattgatgaagttaagagcctcgttcaagccattgaaaggtacgaactatatacgatcatttgttaggtgctttgtaatcacactcatggtataaacgaaaaacgaaaaaagttacaaagtggaatgaatttaaaggattaaaaagtcatatttaaaggatataaaagctcaacatctaggtctctttatattgttggaatgttggtgttctatttaattataaatcattagatgtgatccctaataattgtatggatccaatattaagtaaaggtgggactccgacgccgtagatgtcctaccggactatctcaaagtcgtcttcagaacaacgtttgacttgtttaaagaactcgaagaatatgtgagctctgaagcaagatcttttactatgcaatacgcgtatgagcaggtactgtttcttcatctatttcttaaatctaagccaaattattgcatctataaaaatagttactatacaactaatgttttaaaatgtctccaaacaacaccattctcttatatgagtaaaacaataaggagagcatttggatgttggaaatgttcattttctacgtggtatttttttcctagatcatttagctccacaaattcagccaaaaaataaaatatatatctctatattaaacgaagaattgaaggttatatatagttcgtatttaatataatgttttgcagctaaggatactcatgaaaggatacctgcaagaagccgaatggtcaaatagagggcacctgccaagccatgaagaatacatagaggtcggggtagcttcgaccgcaggtgaagtgctgctagcaatgaccttcatccctatgggagatgctgcaggagtcggagtttatgaatggctgaggtcaagaccaaaactgacccatgctctttttgtgaaatctcgtctcagagatgatattgctacctataaggtaacagaagtcctatatatatatatatatatatatatatatatatatatatatgtatattttaaatgcaaattataaaaataaaatgctaataaatcttatcgtatagtatttcacgtcataaactactttttagttatttgattgataattttgacatgatcgaaatatatgatgaatttgcatcaggaggagatgaagagaggagatgtttgtaatgggatcaactgttatacgaagcaacacaaagtaagtgaggaagaagcgtgtattgagtttgagaaaaagactaatcacatgtctaaggtcatgaacgaagagttcttgaaggcagccaaatttataccgcttcatattctaaggcctgttttgaattacggacgcttagcagatgtgtgctataagtatggagatgggtacaccttcgctggagagaagatcaaagattatatcacctctttgtatgtcgatctcatcactctttaagagtcttcagagtttgggatcacgtgaatggccaagccaaatttgtatccgcagccgcaacccaaaaataagttgtttcagtttaagttgtctttgttttcttggttgttagtctgtcttgaaaaccatcttttaatcagtaataaagcttgtcattagactatcaaaactaacaataatccgaataacaatctatgaatacgtagttaacacttatagtagtgggatttggctttctctgcagatgtgcaattatctatttttttattagcaccgataagaaaaaaaaaatattaattttttctttgttattcgcttagttaataatattaaaacgggcattcttcgaaatatattgtgtacgtaagtgacatcaagcgggtcaataggaacttttcgtagaaaataatccgtttttacatcagacaaaaaaatattcatttatctgagaaaataataattaattgggtgtaatatccaaaagccaaaaaaaaatcaaatcttgaaatgccctgaaaacatgaacactcttcccgtcgtctctctcacagcttcttcttccttcaaattcttccattttccttctctgcaccgttctctctctcattccccaaacttctccttcaccaaatcccttatcctcaatccaaaccacctctccttcaaatccaccttaaattctctttcaccgtctcagtctcagctctacgaggaagaagacgacgaagaagaagaagaagaagacgaagatgatgatgacgaagctgctgacgaatacgacaatatctccgatgaaattcggaatagcgatgacgacgacgacgatgaagaaaccgaattctccgtggatttgccgacggaatcagctcgggaacgagtggagttccggtggcagagagtggagaagcttcgtagtcttgttagagattttggtgttgagatgattgatatcgatgaactcatttcaatctacgattttcgaatcgacaagtttcagagattggctattgaagcttttcttagaggttcttctgttgtggtttctgctccgactagtagtggcaagactttgattgctgaagctgctgctgtttccacggtggctaaaggtcgccggttgttctacactacacctcttaaagcactctctaatcagaagtttcgtgagtttagggagacatttggggatgataatgttggtctactcacaggtgactctgctattaacaaagatgctcagattgtgattatgactacagagattctccgtaacatgttgtatcaaaggtattttgcaactgcagctctctctgtgtgtattttatatggtttgctcaggagcttctttttaacctcaatttttgtgttgaaatcttttttagtgttggaatggcttcttcaggaactggactttttcatgttgatgccattgttttggatgaggttcactatttaagtgatatatctaggggaactgtgtgggaagagatagtgagttttttttcccactgtttctcttctttcctccaaaggctttatctgttgagtgtttctaagttggtttctgtgtttcaaatacgatcaggtcatttattgtccaaaggaggttcaacttatatgcctatcagctacagttgcaaatccggatgaattagctggttggattggtgaggtgagtctgtggacatttttcctataggaatagcttttctttatcgtgttcatatcataaggagttataacaatgtacgtagtgccttgttcatcgtctcatttatcttctattgttaagcaacttatatattgttttgctgatgaagtatctcaatttctagtaatcttgtactaatacacggttatttaagatgctttcgtgttttgttctcagatacatggtaaaactgagttggtaacatcgacaagacgcccagttccattaacttggtacttttcaacaaaacattctttattacctctgcttgatgagaaagggataaacgtgaataggtaactggttcaaatctgtacttttatcaccaacatttattgtaaaatctttctctttgataataattggaggatgctttttaattggagcaggaagctttctctcaattatttgcaactgtctgcctcagaagctagattccgtgatgatgatgacgggtataggaaaaggaggtcaaagaaacgaggaggtgataccagctacaacaaccttgtgaacgtaactgattatcctctttcaaagaatgagataaacaagattcgtcgatcacaggtcttacattatgctttctaacaaccctaacaaactaggcatttgtcgtttcttatatatttgaatatgatttttaacttctcatgataatttaatgactgctgagttttgatttctaggtacctcaaattagcgacacattatggcatctccaggggaaaaatatgttaccagcgatatggttcatttttaaccgtagaggatgtgatgcagctgtacagtatgttgaaaattttcagcttttagatgattgcgagaagagtgaggttgagttggccttgaagaagtttcgcgttctttatccagatgcagtgagagagagtgcagagaaaggactgcttaggggaattgctgctcatcatgcaggttgtctacctctttggaaatctttcattgaggaactttttcagcgaggacttgttaaggttgtctttgctactgagacacttgctgctggaataaacatgccggctagaacggctgttatctcgtctctttcaaaaaaggctggtaatgaacgaatagagttgggtcctaacgaattgtaccagatggctgggcgtgctggacgcagaggcatcgatgaaaagggctacactgtgctggttcagactgcttttgaaggcgctgaagagtgctgcaaacttgtctttgctggagttaaacctctcgtgtcacaatttactgcttcatatggcatggtactgaatctggtagctggttcaaaagttactcgtaaatcaagtggaactgaggccgggaaagtcttacaagcagggagaagtctggaagaagccaagaaattagttgagaagagttttggaaactatgtgagcagcaatgtgacggttgctgcgaagcaggaacttgctgaaatcgacaataagatcgagattctgtcatctgaaataagtgatgaagcaatagataagaagagtaggaaacttctttcagcgagggattacaaggagatcactgtacttaaagaagagctacgggaagagaaacgcaagcgtgctgaacaacgaagaagaatggaactcgaaaggttcttagctctaaaaccgctcttaaaagggatggaagaggggaacttaccatttatttgtttggagttcaaggattctgaagggagggagcagtcagtccctgctgtttacttggggcatattgattcatttcagggttccaaacttcagaagatgatgtctttggatgagtcttttgcgttaaacttaatcgaggatgagctggcggctgatgaacctggaaagcctaatgttaaaccgtcttactatgtggcccttggctctgataactcatggtatctctttactgagaagtgggttaggactgtctacagaactggtttccctaacattgctctagcgcttggagatgctttgcctcgagaaatcatgaagaatctcctggataaagcagatatgcagtgggataaactagctgaatctgaacttggaagtttgtggagattggaaggatctctagagacatggtcctggagtttaaacgtacctgtcctaagcagcctttctgacgaagatgaggtgttacatatgtccgaagagtatgataacgcggcgcaaaaatacaaggaacaaaggagcaaaatttcgcgtttgaagaagaagatgtcccggtcagaagggttcagagaatataagaaaattctagagaatgctaacttgacggttgagaagatgaaacggctcaaggcgagatcgagacgccttataaaccgtttagagcagattgaaccgtctggttggaaagatttcatgcgcataagcaacgtgattcacgaaagcagagcattggacattaatacacacttgatatttcctctgggagaaacagctgctgcaatccgaggagaaaacgagctttggcttgcaatggtgttgcggaacaaagccctggtggatctcaagcctcctcaactagctggtgtatgtgcaagtttagtttcagaaggcataaaagttcgaccttggagagacaacaactatatttacgagccatctgatacagtagtagacatggtcaatttcttagaagaccaaagaagctctcttataaagcttcaagagaagcacgaggttatgattccatgttgtctggacgttcagttctctggtatggttgaagcttgggcttctggattaagttggaaagaaatgatgatggaatgtgcaatggacgaaggcgatcttgctcgcctgttacgacgcacaattgatctcttagctcagattcctaagttgcctgatattgacccagtcctgcaacgtagtgcagcagctgcagcagatatcatggaccgtccaccaattagtgagcttgccggttaaagtgaaccccacattagctctgtctttagtgagacccattggcaaaaaaaacacaagagcctgggatgtgcaagaagtgcatatgtaagaattggggatacaagaacaaatttttcattcagatgattaatgttggaaagaataggagcaacaaagaagaaattttaattaatgttacaacatacaaaatgcttatatacacaatgggaaacaagacttcaaggcttgggcagttaatccgtttagtattccttcgattttccccctccctccctttttattttctgtgagaatacaacagggaccagaggcagtaacagaagtaagagccatcttacatttcttctcttctgacaaagctcaatgctgagtatggcaaccttttatctctcaaaaagtgcgaagttgctctattcccgagcgttttctggtagtaagtgacagatgtcattgaccggtgagaagtttttgatatctttgtgttctcctttgcctaattaaagaaccactgcaaacagaatcatgtgcgaggggtaaaccgctttggtttaaaagtttcctcctcttagcacgatgcaacacatcctcggtgtctaatacataggagacctgaaggaaacaccagacaattctttttaaaaagacgagcttaaagtccttatcatggaaacgcatagtggtgtaagcaggaaaaaaggcactgtacctttgaagaactgcaggttatcttacattccaaaccattaataatcttaacttcatccgtggtgcagagttcatcgtcaccaccatttttacgcttattcctgaaaggaaaatagtatctgattagtgcccctttatctttaaaaggatgggatagcctttagttaattttcttgactttaccgtttcaaatagattcgaggattctctttcgcattaggttgataagaaaggaatacattgtggaggtaagctgcaaaagttgggtccatggatatggatgtcacatcaggcttatcatgtccatagtccagaagctgaatagagagtttgcttggtgtcgattgttcctgcagaataaaagcacaaagatacatatattaagaagtttccttgagcttgcttggtccaaaactgtgctctagtaaataattcttacacattcaatgcggtatatatcctcatcgggaagaagcacaagagcattttcgtaataaacagcatccagaaacttctcaggctttctggatttctcataagcataaagctgttgtaatttgttgtccatctcatcagctgctactgcttggagctggaggatcacattggtcagttggatcatatgtgacgactaaagagataaagaaggtaacaaaacatcaaaagaaaacctacatgcttgatgagcttatagatcagtttgtctaatgtgaagagaacatatgactgggtcccgataattgctcggcaatcatcttcgaactttgaattatcggatgtgccatcgagcaaattgtagagagcatccatgattctgttccaatacagaaactcgatgtataagcaacaacacatatagatgcgtcctgtggtaattggtataaagaaccgcaaaggaaagtcacctggcgtacgaatcagcggggtttgttggatttgaggtcttccactttctatctggagatgatgaattgatttttgctgataatattctgtcatacaaaatctgtatacagagtaaccacaaaaagttagcctccagaaagattccagcgtcattgatttgcagattcaagaatgatatgtttacctgatgaagcctgaatagaacataaaaagaatcattcccataaaagacttgtgagttcttccgagaatcatcgttgtccttatcgtacaaagctggagggacatactttgcaagaggtttcacatgtagcaggttttttactgagatggacaacacaggcatatctccttcagtatcatcatggccatcagacataccttcttcagcctcaccttcactttctaccttattatggtctatatcatcttcgcgataacaatcttcaccatcaccagagtcagttccagaaacatcaccgttgtgagatgtgtttccgctaccatctgatgatcttggagcacttgcatcatctgcagttgcatcattctccttacttttgctgagagcctccatgtcattctctccatgaactgcataattatcttcttcaaaatctcctgttggagaaagttcaccctcctctctttcgactttggcttccccagcgaaccattctgctactgtcccatttggaattacagggttgtcgccaatctgtgggataagtaagtagtttatcactttcgttgataaactcaggactgaagtattttatcatctaaagactgttcagctcaacatttcaatatatgcaataatacctctacgcgtggcccatttacgtaatttggcttcaactcctccgttccactggttaatgcaggttttggattactattgctaagccctggcgagtataaaagaaaaggataccattcttcatctaaaaaacaagaaaataatccatgataactaccaaacaagagttaaactgcttacccgcaacggataaactgctgatttttccattcctttgaggtaacaatccatccagaggtagtgcatttgagttatgggcacgttcaatagaaacagcttgtttggtttcggctctttcgtcaggtgtggtcagattcttcggcattttatcattctgagtgttgtcacatgataacaaggcatctgaggtcttactagaagtaacatctttatccaactcactagcttgccgcacttgattactttcattgacttttcgagggccatttgaccgcatagagttggcaatactagctccattttgaggactgacagcatcttcttggtcttctcggtcatggtttgtagacttgacagcatcttctcggtcttcggcaccttgagggcgagaaggaacaccaaatattggttccaaaaattctgtccataccttcattaccttatctaactgttctgttgaacacatttctccacatgaatacttgatcagctgatacagatcttcgtgaagatcaggatccggataatcaaaactcatattggaagaaatagttcgtctatttccagccgcaagagcaagaagtgcatcatcttcgcctcgcttcttttcagagatctcttttatctctgccagcaatgctgcagtgaaagatagtagtgcataagaacttcataagtagattttttctaggagcattttctcttataatatgtaaggagaaaaaaccttttgtgctcagattctttgaatcctgctgtttgaaataaaaactgcgatgatcaagcgacctgtggtagttctttgtatatatgtcagcccagactttgttaaactcagtacgacaccttgcccattcttcttgcttttgtttcaaacgggttagtattaccggtaaagcaagatatgcattcttctttaacaaatccaacacatcgagcccatggtcactgtataaccgttctatgcatcttaggtttagagctacaagacaaaaacaaaacaatatacatcagttggaagaaaaaaattcagaatatcagctctgctgtaagagaagagctcaatatacctgtgaggtgatcctcgatacagatgggagtatcggttttcaattcattactgttaatctttgccaataactcttcaactcgattagtagccgagatcacagactctaataacatgtctagctcgaacctaaagcacagcaacaaacaaatatttacctaatcaaaactattccaagaaagcactcaacaaataaacatacattaatcactaacctgtcatcttcacatttgaataggctctcttcgtattggttcttgcgcatgtgtttgaatgaatagtcttcacttcctgaagtgacagagacccaatgatcattaagcacttggctaccaatctccattttttggcttgctataggaattggatactgcaagagaacaaagtatgtatgtacatttaactaatgaagcaaaaaataaaaaaaaaacaagaggggaagatttgttagtgattagcaccatacattctttggaagtctccgataactaggtgtgcactgttcacagttcgagagatctagttcactgataggtttagcccatttctgactcgctgccaccttttcaagcctctccttctcacggtctctttctctatacctttcaatcttctcacgttctcggtctgtatctttgtcaagtgacttagtaggttgaggacatttgccttcactccacaaggattctgtagttacagtaatccaatggttagagtcaattcaatacgtccgaagaggtatgtcagaagtatattataaaaggtactagacttactcttagacacgataccagagagtaatccatctgcagaaagaaaacagaaaaaaggtcaaatcttaagttctttgactggcgagtgtaagaagagaaagcactagttggactggttattaccattcttgtcacactgagccaaaaagactttgaaggcgtccataaggtctggatatacaccaattaaatcactcacctaatacaagaatatatatgttcacgagtcattgacaggtaaagtccataaggtttctcacaaacttctccaacttaaccatgcagtgagaaagcttaagtcagcataaaagcataccaaagactgcaattctggttggctgattatctcctttgaatagagattaagacatcgtaagaactcttggttatccgcggtatcaagctttgccttcactctatcaacaaaagcaagttcttggctatgacctgtaaccacataagacaatttaagaacacaacaactagcagagacgatgaactcactcctaactttctaagaaatcaattatgaaacctttttcatcataagtagatgaactcggaatggctccagaaaacttgtctccttccctggcttgatctgacatttcagcagaatcatcatccttacgtatcaatttctttttgctgttgaagaaatgttctttatggctatcgtggtcaagacctctgtaatctttcctgtctctatcatccatgaaatcattctttttgtcaatgcgtctcacttcttctttactatctttcaacaaagacctctcatggtctacgtccatattttcggttttgagggcacggttaggatgcgaagtaataatccggtccttctgtaacaatatccaaaccagtgatgtctctaagaatcaattgcatagtgaacaactatttaaagaaaaagagaaagaaaccttatcaagatctatttgacgcatggtgggaagagacttaatgcctctatcacgtactggaacttttacagaatcattagtagatgcagttgctgaagtatcagggagaaagtgagtgaactctccaagcaaatcgtgatggtcccgaaaaaggatagccacctgcaagttcaacatattgaaaactaagacaaaaatggacaaccaaaacaatgaaaaaacagtgtaccacaaatggctacaaaacacacacctcatggtagacctcagtaatagacttgttttcctttctatacatgttcaaaatgtctaaaaacgatttgtatacacgatcatcgccttgaaaccttgtctgcagataaaatgatagtagttaagaagccaagtagcaagagaagaaaaaaaggggaaatgcaccatatataatcttctaccttaatcttgttaacaaaactaatagcttcctcaaactcaacaggcttctttggtgcagcgggttggtcatcctcgggtcggagagttatctcgaaaccctttggtaagaaagtattaaaccccaaaatcaattctctgttccctttaaaaagttctttcacccttaagataacaccagtagtatcaactctacaatgacaaaataagatcagatttcaaattgaactaaagagcaaaaaataaaataacagtgagcaaaaacaatacctctgagctttaaaatctttcataacctcaagaaactcatcgtatttgtcacgtttatcttgaaatttatccttgacagctttaagatatgcaagtgcatcatttgtagttagcttctgtgcactacttcctccaaccatggtttatattttgccagagcttcattaaccacagaaaccaaaaaatttagccgcaaattagatcactgtgcatctccaagcaaactcaattcaccaaactaaagtctttgaatttgggcaattcgattgaaaataaaaataaatccttttgaatcttaaatcaagaaacaatccaaataaaatattgaactctgcaagcaatctcaaactaaagcagtagatctagcaagtagagaacaatcaaagcaaaatcgagaaaagagtttaagaaacaatgaagcagaaaaaatcgatcttaagaacttaatcttcagattaattcacattacggcgcttcaagataagaattaagaaacacaaaaaaaaaaaacgcttcgaaaaaagtaaaagatgatcgtagagagagttaccgaattttgcagagacacaagtctacaagcacaagcttcctccttaccgcacacggaaacacaccacaaagacaagactttaaaccaaattctttgcagacagaactaaaaagaaataagacataagttaaaatcatatttatggtgaagatgagaagatgagacttctcaaaggttttttaattttttttacttctgccttaattgtaatttaatttattgtttatattatatgatttggtgtaataactattttactattcattaagcccattttttacttaattaccagaaaaaagttttccctgttattttttaccttttccatcaccatatattatttattattatgaaacatattaaaaaaaagtttattaatattaaaaatgtagtaaatacggtagaggaaacaacagtcaaatgattaatataaaaaaataaaaataataataataagaataataaataaataaaaaacggtagagaaacatatatcgatgatggaaaataaagaattgaaaaaaatatgaaatacaacttagagacagccgttgctaggttgcttataggtagagtaaccggttatagccggtgaggttaattgggggattagggcgcagcagagctagaggattggattttggttattttgggaccttgcaattcgggtttgtgtagttcggtgattttgttatttttgggtgatggtgtgggtataataggaatgttaggagaatttaactatcaatgtcatgtgctacaattagtaaattcgaggctttttatgatctagaaagcattttgccagttttgttttatttatttattgaactgttttatttcatgtataggctatattggtagatcgtagatatgattatggatcatttaagtcgtttggttctttaaggtggttttgtgatttgtaatttttctagtttaaagtaagttttcaacttctaagaatcaaataattccaatgaaaaaatcatttctctcgtgtcggttcaaatttagtttgtcagtcggactttgctaatactcttttgaattttgataggtaggtaaacttaagatgactatgtagatgtggataatttttggtgacatagaatatggttatctaacaacaaagtgaagcttcaatcaaattgggcatttggtctagtggtatgattctcgcttagggtgcgagaggtccggagttcaattctccgaatgccccctttgttttacactatctttttaattaatcctacgtacacttttacttcctttccagttttcttatcttttgggcccaaatattggcattttcacacattttagttttagcgtttgttattgtcggcccattatgtacctacacgacccaacttctctcgtttatgtttccccactctccgagtcaaattaacattgacgccaaaatataacaatgaactggcatggtgatgacatggactttggtcaaacattgatgcagtttggatggtccccaaacattgtcgccttcatctcagagcttggctcgaaccgcaaggtggcttcgtcacactcataactcataactcctgtcgttttttctctacaatccgtgagagaaaatcgcgatccgaagtgtacttctttcctctctttgacatcgttaataatattttttccaatcaaaccgccaatatctacttcggaaacattagctgaaatcttaagaagctgaggattgaagtatttgagattgtagtatctgatcatatacaagattcaattagttttgaaaatacgaacgaattaaggaatttaaaacgggtttaaaaaatagtaggaaatagattcattacttttgtggggatgaggtagcaagagtgacattcttgtaaagcaaggaagcttcaaggtctccttgaagacatatatacttaccaggaagatcatcagggatccttatcgacaaatcccattttgcattaagacgagtcattgtaatattttgcaccgtgaaatccattgaagctaactctattttcggcaccgggattttgccagaattgtcttttatcatcaacaaaaccagaccacaaataccaaaggctatgagaaaagaaacgaagatccgcactcctatagatagttcttcgtctgccattctaagtgattgattgaagagaaacgaggaaactattttggagtgcaaaaggaagatgagacagtttaataaagatatagttgttaaggaaagataatttttaagaaaatgaactttaacctatacttaattatatgatatgttattaaaatttagttaaagatatagttgtttttaattaattaaagtatttcaaaacaataattaagtattttcttattttttcatttttctctctcttttttaaaataaatttatcctccatatcttatttcaaaacaataatctcaaacttgctaactctcgtgattgcaacaaatatcaattaaatcatcagatttcaccatgtataaaatctaaaagttttgaaatatttaagataaaaatataaaagtttgtaactgtattagaaaagaaatttagacaaataaagtaaaataaaaaccatatattaaaagggttatagaaaaaaagttgtaaaagttctttatcctacaaaaaaagtctggttttcaaaattaataactcacaattaaagatgaaatgagtaaacgcatcagcttggattttaaaatctgatagcttcttccctgcattcgacttctctcttgttagcattgcatctgatagagctttggcttccacagttgagccacctcaacacctaggcaatattcttttgtttgtatggtttggttcaaattatcttcttgtaccgtgtcgggtttgttgtcgtttatttgagaatttgtaattcgccgtttgttcttttaattagtgcagcaacctttaacccaaaaaaaaaggtttggtacattctcactaagcataattatattgtcttaagtaaattgataaataatttgtgtattatccataatattcagtttaaatagtataaaacaacttgaaaaattgagtactagttttaccagttcagcaacaaactaatgataatccccattgagtcaaatggaagcagataaagtggctttgaaccacaacttgcatggcttcattgtatacataattcatcattcttcatccataatgtggaagaaagagatgaaattcctcaagcaagtctcgatggccttgaaaaaggatagccacctacaaaataatacattacattaaatccaatacaagaaagatggaaaaagaaaaggtagtgaaacatatatatatatacacctcctggtagagctcagcaacgctcttgttttcctttttatgcgttttcaaaacctctaaaaatgagttgaatacatcattgttctgaaatcttgtctacagaaaaaatgatatttaagagaaaagtaaaaaaaaaaattgtacagaaaagagtaatataatttctagtagggctgcaaaataaacagcaatagagaatacaaatgatataaaccgaaatatttacaccgaaactaacccttaattaaaacgataaatctgatatcctaaattttaacactaaaatctaaacaagtttattcatctctctaaatttaaatgactaaacctgttttttatttagattttagatcttttggatcaaaataatcataatcaaactctaattactagtatgattttgcccaactaccttgaccttgttgacaaattcatatgcttcgtcaaagtgagcaaacttcgaatttgacgtaagttcgtcatcactgagtgttatttcaaaccccgttggcaagaatgtgttgaaacctaagagaagctctggttgccctttgaagagttctttcacttttgatatgacgtcacatgttttagctctacaattagtaaaaaaaaaaaaaaacagtttaccaaaactttatataactaagagctgaaactattatgagggaagaagaagaaaaaaaatacctctgacctctgaaatccttcatgatcgtaagaaaactatcatatatttcacgattatcttgatatttagtttttacaagatggaggaaatcaagtgcatcggttgtagttagcttcttatttgcaaccatggttttgaaactgacaactggcaagtgcttcattatccagaggaagagaaaatagattaatgttcgactcccaatataaacaactttgaaaatcaatacaagtcttaaatctcaataaacgaattcaagatatataagttcaaagaaaaataatcgaaattatcccaaaaattcatacaaccagcgcagatctagcaattagagtcatagaaaacattgcaagggaatttacagctatcgaccagaagatttgaatctaacttactcctcagattatgtcacactatattttgatctaagaatttcagtatagaaacaagataggatcaaagtgaagaggatcgatcaaagttcgctaggacacaagtattgatggacacgttacctcacacgtaacaggcttacaggaagatacaaaagacttgacaattgacacaaagaaagtcgtaaggttttaggtttataaataactacatgagtcatataaagatacttaatatcacgtacgttaaacataatctttttgttaacataacgattcgattttctctcctttatatggattttttactctttttcttaatataccaaatactacttttatgagtcttatccaatatttatagaaagaaaaaagtaggccttcagattaaaaacaaaattgataagtccaaaccgaagtttgtgcaaatcggttctagtttggttattagatacaaaccaatcggtagatttgatttcgaaatttaattatcggttcggtacgttaaacagactaactaaataaattttttaagttgatgtaatgattaacttatgatattgatgtagtaccatatgtttaaatagaatctttttaaaaaatagtatcttactatgagagtataattattaacgaaaataataatacattagaacaaagtatattccattgaagccaaaggaaaaaaaaacaaaagcgcattgtgttgtttaagttctttcctacgatatcaaaaggcaaaagaagaagatccaacatatgcaaactaaaacataaaaatcattattgatgaaaattttacttaagtgtgaatatagtggcatataggagcggcgttttcaaacgcagttgccttcctttgagagccaggctcaaaccgaaccgcagtttcatcacacgtatagttcatcttcctcccagatctacaatccggaagaagcaacctcgatccgaaccgcatgtctcttctttcctttatatcgtccataatgtctttcacaacaacactgtccatatctccctcagaagcaattaccgatgaggtattaagcagctgaggccaatttggtatcagattgtaactgatagagcataacacaaaaaagttcaaacaaaaatatatgaacaaacgaaattagttaaagaaaaaaaaaaaaaaagagtattgaaatttttaaaaagtgtaacctgtctaaggatgaattagcaatggtaacacctttgtaaagtatgaaagtctgcaaatctcctttgagacacatatagtaaccaggaagatctgaaggaagcctgatcactaaatcccatttaacactaagactagtctcggttaaattaaggactgtgaaatccatagatggtattataatatccggtgcatagttttctatacgttgttctttacgccgtttttcacgtcgttcttgtgctgattcagagtaggcataaacgataattgcagcggttgcgatagcgatcaaaaaaaccaagacacacgtgaacacatactttttttgtcgtggtgtaagtctatcccataaagtggtggatttaggagctattatttctccgttttcataatccattgaaacccagagagagacggatagagagatgtgtatatgcaccagatttatgtatcttttttttgttagggttattaaagaaaagagttggtatattgttcttataagaagatttcgataattacatatcaaattttttaaaaagatttcgataattacatataaatttttagattttggtaaataactttcttttcgctaaagatattttagattaaatcaaatagtaatcttagcgttaattggctatgaatcgtcggacagagaaaacttctcaaaggatagaaataggttctttatgttgggctttagatcgttaatgggccataaaacgttaagactcgggactttgggagtgctccagcttgtttggctacgaatcaaagaagcaggctagaacgaaaaataaatcatatgatgatcaaacatagtatattagttttattatcggccaagatgctgtaatttgagatgtttcttaacaactttctattatcacctcgctacaattttaccattctttaccgcaccaatttttttttttaaatagccaaaacatttatttttgtttaccaattcgttcaatagtgaaacttgagtgaaatttttataaactttgtttagggagaaagtattaattgttaaaaattctaaataatacagaaaaaatgttggatatacgaatcataccatggataatttagtagcaccttatattataatcttcagaatattttgtagcattagagagatcaactaagaaaacagtgttgaattctataattaatattttgaaacacacattaatttgtttaatttttttcgtaccgccgcatctcaaactaaaagtaaccagttgtgtataccaaagtatggtctagtcatgaagatgacaattagaagcaactaatcaacaccttaatcttttctcgtacttgatctcgtatcccaacatatatattaattatctttctttccctcacacaccacacgtacatgaatatgtatatagtgtatatactttttaagtaatgtatgtcgaattaaactccaagagaaagatattcgcgtgctttacaataagatatacttataaattcttacttataaattcttttaaaggacctaaaaactgtttttttttttcaggttttggaatgcctttactcttatgaaaagtaatttcgaattatccgtacaatataaattaataaagtaaacttatggttctatgaaatgttattgagatcgacgcttattgtaatttatacgtaggttctatgatatgttcttgagatccatgatttctaatgtacgcgctgcagttacataggttttaccgatgaacaaatttctcatattcattgttgttcccagatttttattttgtatttatggcaataaatttttttagtaagatttgcttagattgactcaactcttaacataaataacttaaatgacacacgtttggtttcaaaaactgtagtaagccatatctttggtaaaaagacgaaataaccttaatgattaattgtaatcaaattaaaacaaaaaataaaaaataaaacaaatcttttatattttaaagcacaagtcactccaccaataaaattttgacaaatcagcaaaaccaaattatttttcaacagaattataaaatcaaaaaggaaatcgtggataaaaaagaaaaccaaaacctatattacataattaaaacaaaaacgaaaatccgtgagaacaaacttttttttaaataataattttgaacaaaatttagataaagaagaatcttcttcacatatttcgtttttgattttaaaaatactaaaaaaaaacaatttaattttgatattgcatattataaattgacttgttttagcttaccaataatattttgacatgtatcaattcacaaataattgatttgatggtaggaatagaagaagaaaaaaaacggttatgaaaacccttggagaatttattatgactaataaaattcattaaaattcaaatatgacaatattatgtaaaaatctgccgacattaataaaagtctgtcgtgacgttatgaaaatttctttttcaaaaaaaaaaaaaattgaatcaaaccggatttaacctacaatcaaaccggaaaatttttacttgagggctagttaataaatctcatgtaacaaaaaaattcgaaattttaaaaacaaatctgctaacaaaaagtctattattactaaaaagtttattctagtcataaataaatcggccataacattgatatgagaaaatctgttatgttttaacactgaaaaacaaaactgttatcactaaaaataaatctgttatcactatgggactgtctagtaattttattttttaacaaaaatctgttataaaacaccagatttgttaacaagttaattaaatctgtgattacacaaaacaactctgtcatgactatataacatttttttgggttaacaaatctgttataacacaacagatttttggttacaaatagaaaatctgctgctaccataaggaaaaatttgcggtatggaaaataaatcagtgacagatttggtttcaacattctaaattttgaaattttagaaaaatctgtggagactatataaaacaaatctgtcacgataaacaaatctgcgaaaaaataaaaatctgtcgtaacttaatccagtaaagtctgtggtacaaaacaagtctgttgtaaacaatctgtggttgaccaaaaaatctgtgatcgaaaacaaatctgttgcaacaagagccacatattcaccaaaaacgacaatggcagttttgtaaataaatgtgattttattgccatgctggaattaaatagtaatgacgtttctgtaatattattttttctgcaaaggaaaacagggacattttaggcataattattatccatataactcatgttttttagtattcctttttggtcattatgaatgaaatatggatcactctggtaattttccctaaattttaatataagactaatggaatataacatttcaaaagaataactatatatcggttgacgtcaaaaaacaaaaaaaaaactatacagtatatcagttactctcattccaaattattaggaaaaaaactgaataattaatttatcttttctatttttataaatgtctatgacgttattaatgaaccaattgtaatatgacagtttttataaatgtctatgaagttttaagttaagtttccgttacaccacggtcgaattttactcgtaaacattcgctggtctcgtttttaacagtttgatttgcctcttgaattgggatttgtcgacccctacaacaagttaactggtgtcagtgctctgtgaagaaaaaattcgacaattttttttgttcgttatatattaacaataaaacttttgaatcgttgattctactcaatctaaagaaaacgtagacatagatggtctttaccaattaccatttttgttaacgttggtctaggtattagctaaaagaattgttatgcataaaaatagccatttcgttgtatcttggacgtacctaaatagattgaaccgaattaaaacttacacaaaaggcagctctctgtttacatattcgttatttttcctagatttcgtttatatattaactcaaatagatatatgacatgacagaaagagaacatagatttagtgatgctacgataccttcaaatgtctaatttcatttgctactttatgttatatcatgtcatatatctacttgagttttttttttatcttctttttttttttttgagaaagagtttttttttatatcattacgtgtaattacactcaaattaacgttcaatagttactaatagcttatgggtacaattcaatctaatgtgcgggaattgttggagaaaacatgttggaggacatctttatgaaaaggagaagaagaataagtaaaggaaaccaaatttgattaaaattttaaaaggtcaagaagatgatacatgggtccatgttgtgctatcttcgctcagaatcacttgcccgcacaccacaaataatctcatcattttatgttttatttatttcccaatatagattggaaaactatgaataaaattggtaagctacaaatatataaccatccaatatggtagcatgatgttttcgaatcttattttcttagttgtcacccaaatttcaaaactgttgttttctattgcagacaagaaaaattatgaatatctttctgactaatatgtatatttacttatttcaaaatagataatattctagataccaacgattttaaatgagggactacaagatgtcaccagtaaaaaaaataaagccagagactaaaaaattgctttgagggagagtacatcatctttctctgtggctgagatccattgcaacaagaatgaaacttgaaaattcaaactagttttaggacttaggatacaatagtttataactatacgaaatgtaatatactttggtataaattttcatactaacaaactttttttttacaaaactaagttaacattatataatttaaaaacattattgtagagaaaattcttttgtgatggcgcatttttaacacctaacatattatattgaattttgcaaatcaaaatgtatcatatacatattttcaagaatcgttttctaacgatcactttctacatgcatcatgcatgttagacaaagtagcaaagttgtgttcacataactttacgaaaaagttaatcatataatacattaaaatacatgtctcatgtaagatgttaattgaaaccatacaaaaatatatagacaataagtgtgtaatgttgatttagggattaaatattatagttgggaacaagtgaatattgggtgagggtaatggcccatgacaagaatgaagtaagtgacaactaaatctttttcaacaaaaaaaggaagcgaccgaatatgcctccttcaccgtccattcactctttgttccctccaccactcttttgtcaatccatttgttttcttcttatttaattctaatacactcagattacaactttgggtctgaccataaatttttgcatttttaagaatcaatcattcgtatatggacatttggttttcgattacgctgctggaaattttgtctagtgatgtattagtgggatagatttacatatattgttcgatagcttcacagtcaacgattattttggctctaaaaaaagatttttaaaaaatgatgttaactaaataaaaagaaagataatataaaaggagatctacggaatatagtcgtagtttgtctccatgttcatcttatatcaaaattgttaaagatttgaactctttatccgatctagaggacaatcaacgaaagcttcaaaagctgttagttcgtgggaacttggtttctatgttaacatgatgttcctaagataatataaacataaatattgcggtcaaacataactgtaagagtttgtaaaatttagtgaaaatgaatgatcaatttgctaacgtatcatatttatggcacgggattataagtatgcaacatagattactacccttgtgttcttttttgcaacacgtaatttatttttaatcatttgctaatgaattatgtatgccattaaaaattatcaattacatacgtcataacactaaacaaaatgctaatactattagtaaaacaatctcattctcattaattagcaaaagagtacaattgggggtttatatacaaactgacattggcctaaaccataagcctctaaaccaaaattaagattggtttatagaataccaacctgtacagactctatatgaaatctatactaaccaaactaagcttatatacaacaatctaagctatatacattaatagtccccctcaagatgagacgaagatgttgagtagacccatcttgcttattagacgatggaagtgagatggatataaaggcttggtgaacggatctgcaatttgcaattcagtattgatatgataaagttcaaacaaacctttaagaagtcgttctctgacactgtggcaatctgattctatgtgcttcgtgcgctcatggaagacatgattgttagctatgtgaatcgcagcttcattgtcacagaagagaagagttggcttactcaatggaacctgcaattcctttaagaaatttgtaagccaaaccaattcatcagttgcaacagagagacttctatattcagcttctgctgatgatttggaaacaacgtcttgtttccgtgatttccagcaaataagagagtcaccaagaaacatacaataacctgatgtagagcgacgactatcacgacaggagttataatctgcatttgcatagaccttaagctgaagttcagaagttgcagaatagaagagaccttgcccaatagtacctttaatgtattgcagaatcttgtaaactgcttgtaaatgagctttacgaggtgccatggagaattgagccagcttattgacagcaaaagtgatgtcagggcgtgtgatgttaaggtacatcaatcgtccaatgagccgtctataaggtccaacttcaacaaagtcaccaccactatcatgagcaaaaaccatacttggatccataggaatgcttgatggcttacaaccaagctgacctgtttcatcaagaaggtccaaagcatattttcgctgacttatatgaatacccttatctgatctaacaatctccaagccaagaaaatatttcaattcacccaaatcacgaagcttgaagaatgatttcatctgtgactttagaatatcaactgctgcatcattgttactagcaatgatgatatcatcaatataaactagaacacagagaaagatgccatcagagattttcagaaaacaagtgtgatcacagtaagactgaataaaacccagaccaagtaaggtagatgaaaatttgagataccactgccgagaggcttgtttgagtccatataaggacttcttcaaccgacaaacagcatttggaggtaaggagtccccctgtcttgatgcatagccttgaggaagtcgcatatatatttcttcatctagatctccattaagaaaagcgttagatatatcaagttgtgtaagagacaatttaaaacgagcagccacaccaagaagaagtttgacagagttaagcttcgcaacaggagaaaaagtctcattgtagtcaatcccttctttttgagtataaccttgagcaactaaacgagctttgtatctctccacactaccatcagaattatatttgatcttaaagatccagcgacaaccaatacaccttttatctgcaggcaaagagcaaacttcccaagtatgtgtaccttctaagaaatcaaattcagcacccatagcatcacgccaaacctgaagtttctctgcctcagtatagttagagggttctttagttttatcaagacaagcgagaaaagtaagataaggatcattaatcctatcataagagaggaattttcgaatttcatgtggagttgaagacactactgaatgacagtagtaatcttgaagataagcaggctttttggccttcctatgcgatgtttgaacagaaggttcagggacattattagtaggatttgcagaaggcaaaatctctacagacgatgatgaatcagaaggattaacatgatcagatgattgacgttgcataggaggtgtaggattcagatcaggaaagaaattttgctcttcctgagaaagatctgatccaagaaagggaaagagctcttcatggaacacaacatgtctagaaacaattatagaatgtgtctctagatccaagagtttgtatcctttaaatccagatggataaccaatgaaagcacaagctttagctctaggagaaaatttatgtctgtctttgggagaggtggaagcataacatagacatccaaaaactttaatatgatcataagttggaacagtcttagttaacacctcaaaaggacatttgtcctctagaataggagcaggaagacgattaatgagatacactgcagtaagaatacagtctccccaataagaaataggaatgtgtgattgaaagaaaagggatctagcaacattgagaatatgctgatgttttctttcaaccacagagttttgctggggtgtttcaggacaagaatgatatggcacaatgcctttagaatgatagaattgagtgaaatttaattcgggagcattgtcagacctaacccctttaatagtggtttcaaattgattttctaccatagtgacaaaggtggggataacagtaaggacatcagacttatttcttaagagatatacccatgtagctctagaataatcatctacaatggttaagaaatatctatacccatcatgagtttgaacagaaaagggaccccaagtgtctatatggattaaatcaaaaggtctgctactcttattattatgagaaacaaaagggagatgtttttgttttgatatatgacagacccgacaatgaaaatctgtattatttttctgttttggaaaagataacaaagaggacatgggttgtaacttttgaactgaaggatgacctagccttttatgccacaaatcatgactagtaacagacgcaacagttatagaagaatctgtacctggatgagataatgaatcaagatccacaatgtacagattagctacttgtttacccattccaaccattaattcccgtgtagcatcctgaagaacacaggaagtttcatcaaaccagattctacaccccatactcttagttaaagaactgacactaagaagattgaatttgaactggggaatgaaaagaacatcattaaggatgagatgtctacccaagtgaactgaacctataccaacaatgctcacacgaattccattaggcaaggaaacagtagtatcatgaagatatttaaaggaagaaaaaaaatgtttatcatggcaaatatgattggttgctcctgtatctatgacccaagaatgaatagcagtgacattgctatctaaagaacagacataaggcctagcaattccggcaaaagaacaaaggatagagggaaaaaggttaccggaaattgggcacactgtggaagaagaagaaggatcggaagatactgagatagagtgtacttcaggttgaacgggagtactaggaggctgaagtttggaactcagaaaggacacaagttgttgaatttgagaagtcgtcaaatcaccagtcgaaacacttgtgttgttaacaacctcttctgaaccaatagcagcattagccgagatagaaggcttcacaaatttctgcttagacttgaaagaagttggataaccatgtttcttgtaacaagtgtcttcaacatgaccaggtcgactacagtaagaacaaactggcctctcctttttctgataagtatctccattaagagcagactgtgaagactgattagagacaggaaacactgatgaagtcattcctggagtagtagaaatccttgcagaacgttgagtttcatcttgatcaatcatgttgaaaacctcagacaaagatggcaaagttttcttcatgagaatctgactcctaacagtatcataacaatcattgagtcccataagaaaatcaatgactctattagtctctctttcaatcagaagatcttctacagtccgtggaacagcctgaagactcgtcaattcttcccaaagagtttgagtacgagtatgatacgatgacaaatccagattgccttgacgaagagagtgaatctgttgacgcagcttgtaaagtcgagggaggctagatttgtgaaatcgagtatagagatctttccagattgcagcggctgtgggaaaatacaagatgcttgtatagatctcctttgatacactattcagaagccaagacttaaccatactgttacaacgacgccagattttgcaataaggatcatcatcatcaggttttggaatagatccatccacaaatccaagcttattcttagcttcaatgctagtagtcatagctataatccaggttccatagttgtttccatctaacagttctggagctaggactaaaccaggatgatcggagctaacaagatgataaggactatgactattatcaggagaatccgatacctcaaagtgacgcgatgagctatattgagctggttgatgaatcgcagcatgaatcgaggatcctggagctctcgctgatgaaccagaagactgctcatgaatcttcggtgaagcaatgacaggaagatccggtgaactactccgacgaacactctttccatttcgtttacctatggagaatcgaaacagctaaccaaagagactgaatcgcaaaggagacgaaaggaaaacgtgtagaagagagaagaagaacaatgagaagatgaacaaactccggtgagattccggtgagattccggtgagatctaatcggagaagtttgttacgggactgagatcgagatattttgctctgataccatattagtaaaacaatctcattctcattaattagcaaaagagtacaattgggggtttatatacaaactgacattggcctaaaccataagcctctaaaccaaaattaagattggtttataaaataccaacctttacagactctatatgaaatctatactaaccaaactaagtttatatacaacaatctaagttatatacattaataaatacaaaccttcacctaagaaaatatctttaacccgacataaatttgttactacggacatgtttttgtttaattggagaaagatatatgattgtgtatggtgtctattgattgattgtcacagaagtataggcattttctgttattggcaaactaagaaagaaaagacattttccactagttatgtaatgcatcttcgaaatacccaacggaccaaacctgctcatcctttccgtttttgatattatataacaatattttatatcttttaatcgctaaaaacgaatattatataaatgtattggatgtccaaaaaaaaaaatgtgaatggaggctttcatatgctatatcactatcaaccaatcacagaacatctttgacagaaggttacctatgcacgtacactacacatacgatgctctttgtttatatctttgcttatagtttatcgatgctaaccactgtaagaattaagtaaagttaatgccaatttaacattaagttaaaattactgtaaaaagtaaattagataggctgccttttaaaaaaattgttgaattataaccatatttgcttttcaaacatgcatgtcccaagtaacagaacaaacaaaaaaaagaagaagtttggcgtaatgctcctataccatgggttagtgctctcaagcgggtcatgtgtacaccaacaatatcaatttttgggtgtttgcttttaactgaaaaagtaaacgcatcgaatctttattatgatttcgatgaataatgataaaatttgggacaatttcaattcaagtgaggaaaacgtgtctgtgccttcttggtaaatctaacactgaaatttgacacgcagttgcttctatagtcagtaattccaataaagcatctaaaattgcatttgaatatttaatcatagtcgtccctatcaataattgtcaccaacaaagataaagggtaaataagaaacatataatgaaaattgaatggtcgtagttttatatgttagttggaaccaaagattcttcaatctatcatccactcagagctacgtggacagtcgatattttgggttatataaaaaaaaacaaaattgtactataagacaaaagaaaacagtattaaaaaaaaaaaaatcaataacaagattatatcttatcccaatgaacaaaatgaaaatttagttattttgaataatgttacaggttttaattaaattatactatatcacaaacagcaagagtcagatacatcgaacggtccagctttcctcctttatttttttctggctatcgttttgatgcaaagttgtttcgttaatcgtgaaaattaaaaagctacagcaatcttctccgaaacttcatacactcgccgacaagagaaacttcatccactcggatttctcgtaacttgcagcactaaacatttcatgaaactattcacaaaagtccacgaaccttgcaattggccacaaaatttaaaatacttatatacgtaacgacaacctatccatatttttctttctaacgatccaaaactggccacgcttcgactccatggtgatattaactagggaagtggctaatggcaaacaagtgcttagaagtggtaaattcaaataataaccgtcgattatttctttctaaccgttattgaggttaccaattaaaaaaagtgatcacaaactaggtcaatgaaaagggagattttttgttttctttgggccaatgaaaatagaaactaagatggacaaaagaaaatattataattggacaaaacagagtcatttgagatttaaaacagagaagtaataaaggtcaaatgtttttgtggtgagctctcaaaaacagacataaaaaaaagaagcagaatcattcccatttataacaaacctaaacctctcttttcttcttctctttacctttttcattccaaaatctctctctctctctctctctttctctggctcgggaagaagatgtcacgtagttgctcacagtgtggaaacaacggccacaactctcgcacatgtccgacggacataactaccaccggtgacaacaacgacaaaggcggcggggagaaagccatcatgctttttggcgtccgcgtcacggaagcttcatcatcttgttttagaaaaagtgttagtatgaacaatctctctcaattcgatcaaactcctgatcccaacccaaccgatgacggtggttacgcttcagacgacgtcgttcacgcctccggtagaaaccgtgaacgcaaacgaggttaataaaataacctttcttctctctttcccaaatctcatctctgtttttgtttcttgtttttgaaactttcttgcaaatttggaatttaggaactccatggacagaggaagaacatagattgtttcttactggattgcataaagttggaaaaggtgattggagaggaatctctagaaactttgttaaaactcgaacacctactcaggtagcgagtcatgctcagaaatattttctccggcggactaatcagaatcgtcgtcgtcgtagatcaagcctcttcgatatcactcccgattcggtaacgtttcattctttaaaatctataattaaaatcaagaatctgtaagattatactaacacataaggttcgatatgtcaacagtttataggatcatcaaaagaagagaatcagttacagactccattggagctaatccgtccagttccgattcctattccgattccaccgtcgcggaagatggctgatttgaatcttaacaagaaaaaaactccagcgacaacggagatgtttccgctgtcgctgaatttgcagaggccgtcttcgtcgacatcgtcatcgtccaatgaacagaaggcacgtggctcacgtgcctcctcggggttcgaggcgatgtcgagtaatggagatagtataatgggagtggcttgatgaagaagataatgttttaattaatttatattgtataagataagatctggatgatgattaatttgaaatttgagaattaggctaattagatactttgatcagaatcaagtgagtttttaagtttgaattagtgtgtacatgtttttttgctctttttgggggaaacgacttgtcgtttttgttgttgtatgatgtaaaacaacaggtagtctctgtgttgttttggtcaagacttgatcagattcagaagtgaagacgacttcaagcttaagatagtttagatgtgtcttttgaaaagtttaaacagaatggttattgggttaaggttaagtgtatctcatatgctttttctatctttttttttggtaagacttttccagtaatttgccgttttcttcggggtgtgtgttgttgataatgtcacattcatgaaccaaacacagttatattactttagtaacagtttttttttgtttttttgtttgtcgtttgacgtcattttgttttatttatgttattacatacatggatataatttatgaaactgccaagaaaacaaagaatataatttgttgaattgttattggcctaccaactatatcagcaagattcgaatctatactttgttaaaatgtctcaatgtaggactggactggagataaatataaagtaatatatagggtaaagtttctaagtcttgtatagcatgatttttattagggaatagaattctaatttcatgatgtaattcaaacaactgaaatggaaaattgtttaaaactagctaaacttgtacagttgtactatttagagcccaaagtgataactgttttatggcttttatccatgcaaaagaaaaacatcaaaataaagtgatgtccatcacatacatcttaaataaagtaataatgggcctagctaaggtatagcccatgggcttattcgctgatctaaccaaagtgtcgctaattttcttccttgtttttttaacgcaaattttcttccatgtcaattatgtctttttaatcaaaaattcctccacaccaaaaaagaacgtaaaaactaaaaatagaacaaattcaactacactcagataatcgaattgctatgtccaatatccaaaacatttcaagccatttagtgctctcactaaacatattttaacaaaatatgaaataacattcccaaaattgcgatcaaaaggctagaaacatcttcaacaattatgacagtcctaaaccaacagttcaaacacgttttatatctgtttggccaaattaaacgaatataacataaaaatacgattgatcttagacaattactaaagtttctaaataataatctatactttcacaaaacaagaaatacaaattgattcttgcgcagaaagtgctttggtacctactttttttaccacctttccttttcaattgagacatcaacacattcactaaaacaaactctcaaactgctctaaacgacaccgtttagttacagataactttacttgtatttaaagtcaccaaaagtttgaatttttatttgtgccttccacaaagctttaagcttaaacacagtcaatggccgtccttccgccataaaaggacaaaaaaaaagcttccctcttttcacaaaaccctaaagaaacaaaaaaaaaaccatcatgaaaacgatctcaatcttcttcgtcatcatcttaatgtcatcttctcacgcagaagacgatgtactctgtctcaaaggctttaaatcatcactcaaagatccttcaaatcaactcaacacatggtctttccctaattcatcatcgtcgatttgcaaactcaccggagtttcttgctggaacgctaaagagaatcgaattctctctcttcagcttcaatcaatgcaactctctggtcaaatccctgaatctcttaaactatgtcggagtttacaatctttagatctttcctttaatgatttctccggtttgattccttcacaaatatgttcttggcttccttatcttgttactttagatctttccggtaacaaactctccggttcgataccgtctcagatcgttgactgtaaattcttaaacagcttagctctaaaccagaacaagttaaccggttcgattccgtctgaattaacccggttaaaccgtctccaacgactttctctagctgataacgatctctctggttcgattccctccgagctatctcattacggagaagatggttttcgcggtaatggcggactttgtggtaagccgttatccaactgcggttcgtttaacggtaaaaacttaacgatcattgtaactgctggcgttattggagctgttggttcattgtgtgttggatttgggatgttttggtggttctttattagagataggaggaagatgaataactacggttatggcgccggaaaatgtaaggatgatagtgattggattggtttgttgagatcacataagcttgtgcaagttactctgtttcagaaacctattgtgaagatcaaattggttgatttgattgaagctacgaacggttttgattccgggaatatcgttgtttcgtcgagaagtggtgtctcgtacaaagctgatttgcctgatgggtctacattggaggttaagaggcttagtagttgttgtgagcttagtgagaaacagtttaggtctgagattaacaagttaggtcagatcaggcatccgaatttggttccgcttctcgggttttgcgttgtggaagacgagatattgttggtgtataagcatatggctaatgggacgttgtattctcagctgcagcaatgggatattgattggccaactcgggttagagtcgctgttggagcggctagagggctagcttggttgcaccatggatgtcaaccgttgtatatgcatcaatatatcagctcaaatgtgattcttcttgacgaagatttcgatgctcgtgttattgattacggtttggggaagttagtgagttctcaagactctaaagatagctcgtttagtaacggcaagtttggttacgttgcgcctgagtattcgagcactatggttgcgtctttgagtggagatgtgtatgggtttgggattgtgcttcttgagattgttacaggacaaaagcctgttttgattaacaacggtgaagaagggtttaaggagagtttagtggagtgggtgagtaagcatttgagtaatggtagaagcaaagatgctattgatagaaggatttttggtaaaggatatgatgatgagataatgcaagttttgagaattgcgtgtagttgcgttgtatcgaggcctaaagaaagaccgttgatgatccaagtttatgaatctttgaagaatttgggagatcaacatggtttcttctctgagtatagcgatgagtttccactcatctttaacaaacaagaacacttaaaatgaatgaaaaggttttattactttcgtactccaatttgataccacttacttatctaccgttctcacttttaaccgcatttttttgtttttttctgttttgtttttgtgtgctgtataattctgtacatcatgtgatgcatccaatgaaaatgagaagaattgttttatatagatcaaactttgaagattctgattcaaaaagtctatcaagtgttagtgtttctatgagattctagttgtagttgttatcgaacgatttgaaattcgatttcaagcgaaaagacattatccaacgatgtttctgtttcttctaatgattctatggataattataatcttttctgataggagaaaaaattaatgtttcccaagtcgctaatgaaaaatttgataaaattttataagataataggataatattttttgaaaatctttgtgtaaatatatagtcccttaatatttaaattgataatcatataaattacatatatataaattgatatattaatgtactttatgcttttagtgtgtgtttttaattaaaattaaattttttgttacagcttatctctaatttttattgtataaaaaaattattatgttgtgtttttaaaatattgaatcgtaatatactttataaatatgatagcattagtttgaaaaacttggtttggagtgaaacattctctatagtttttaaattttgaatatatctcatttttgcgtgttctaaaaaatagaatatatatcattttcattttaatagttttatttttaagaaaaaaaatacgacaaatgaagtcaaaagagtatgtagaactgaattcatctaaagagtttgtatttttttttttaatttacatctatcgtttgtataagtgaattcatctaaaagatttgtaatttattatcaaaagatggttttcctaaatattaaaattttacaatatatcaaaactataaaaaaatgataacatgcacaacactaattttgtttagataaaaatttcttaattcatcttttaataaaaatttaacaattaattcttttaaaaattattaaataatagtagataaactaataatactataaattaataaaatatcacatgatctcaacatttttattttatagaggttttactgtatatggaaataagaaaggtaaaatattagtagaaaatttggaaagaatgaaacaaagtagaaaaactggaaactagatatatgtatattaaaattttggcatgcatgatattacattatacatttttataatcacattttttcaattctctgtatagtaaattttccgtaaatctcagtaattaacttttatttctatgtatctagttatatatacacgctctttgtttattttctctgtcaacagtaaaaacaacacacaagataagaagctaagttaagatctttgaataagaagaaagaagtatgtcgaaaattttgctcctcataggacttgctctccttgtaatccttgcaattgctgttatgggatacttaataatgaagcgtggtcaagaatagaagccggatgtttaatttaacggttatgtagtttttttttttttcttctttctccttagagtgttggggtgaaactataaaactttttgattttctatttgtgttgctccatattgttatcagtggatagaagtaggaatgatttctagctatttcatgtgtgtttgtgtcataatcacctaagaattatgattttttctaaatcttatggatgtcatctgacccccttaccctccatgtaaatcttaatgactaactttgaaaacaaaattttatacaataagataatgaattatggaaacgaacaattagctcccaaatccaccttatgggctagacttacaccacacaaaaaaagaagaagtggagacgtgtctgttgttcttctttatatgtatatcaccattgactggttttatgcagcacaaagaggtaaacaacaccagcgtatgaaaaattatgatccggatattataataccatctatggatttcacagtccttaatttaaccgagactagtagtgttaaatgggatttagtgatcaggcttcctttaaaccttcctggttactatatgtgtctctgttggaattgagaatcctagattaaatcctgcaataagtaaagcttggttgtgaagaacagaagaagcatcgtaagaagaagacgatgtcgatgtcgagaagagacgtcgtgaacaaggtcaacgacaacaagaagaaagcaaagtcaacacaaggagatgttgggctttgtagttttgtaataattatactattgggctaaagaaataaattaataggcccaatgaatcaaaatgttatgaaatcggtttaccattcaatggtagacataggattatgttgggattcgataggattaattgaaactatcggggctaattttataattctcttaggtaaaaggtttacttgagaaataatgagtagtatcggggctcttatgtaaattatcacatctcttctgcgagttatttttgtttctacgaagaaaaaagaagaagaagaagaaacaacaaaaatggcttctcagagttcttcactttttctggttatcttcttcatcttcatctacgcttcttcaattccatcctctattctcgccagagcacatgaacagtttcgtacttacaattttcttccaagttaatttgaatctgacgatgatcgatctcgcttgttgactcgtatttgatttatcgatctctacagtgacggagatgaagagatcagaagcgttgggcgtagattccttctaggtttcaaagaaactccaaaaggaagtaatatcaccttcgcttgttctccttcaggtccttgtgtctcttgcaattcctccgaaaaggtttttcaaatttcctctctaattgctctgttttggtatcggatctgtgatctagggtttcagaactagcttaatctgattaatcagcgaaattgattatacagtgaattggatttggttaggaatctgaagaacatttatatgatctagattgtttttttggtgatctagggtttcataatcaataatttatcggcctaattgattatacagtgaattagatatggatttaggaatctgaagaacatttatatgatctcttctctttgttttggttggtgtggtttcttttgtagagaaaagagaagtatcgttgcagtgaaactggttatcgtattcctttcaaatgtaaagaggttagagaagaagtggatgcacataagaaaaatggagaagaagaaacacaaaatgatcaatcgaataacaatgacgaagaagcgaaaacaaggaatctgttggatgattcatcaccggcgacgaaagtgaagtctcagtcttacaaaacttatagaagctgtgtgccatctgcagacgaagagaagttatcagttcttggttttgaggtacagagaaacacttacatttcaacaagtcgtttcttttagaatatgtgctaatgttagattgttttgaataaatggacagtcgattatgctaggactgtttctgttaagcggagctgctatttacatcagaaagagacagacggtaccgatgcttggggtatcatcaagtggaagattgcaaggcaattctcggttttgaaagaaccatttctcggtatgtaaaagctttcatctgctcactcagaaacagatttaacatttgtcattgtctgttgaaagatgagatatgtttgagtgtatagaatagctttagggggacttcatataattgggactacttgtttcatatatggcaaccatgtttggctttgatgatgtaactttgcttatcgtctctgaactttagagaaagcatcgattacggtgaaacgatgtcctcacttacctttagtagtttggtatatagtatgattgcttggtcttgaacctcggtgatgagcttgctggtaggaagaggttagtacaactgtgcaatagactagttaaagtaagtaacgtatcattcttgagtccaacaggtccaacagaaaccttacacttatcaatgtgcctaagaaatgtggaccacggtcaacgacaaacgaagatactatgaaggatagtgtcgcaccgtcaaaactaatttgcagtgagtagaagtattaaaccaaatccaacaagtgacgttgcatgtaaaaacggttgtaaaaagttgatttagtttataaaaaacgtatcttcagcatacagtttatcgttaaatttaaaagtaattatatgtaaattgcgagcgatgatagaaatagattatataacgtatagtaatcaacaactcttgtaaattcttcgagcaaattttctcgttgggcaatgttgaagcctgcataaaaatagagacccgaaggattcttatagacgggagtggtcaccacgttagcaatggagattgtttacaaagttaccttttttttagtattttaatctcgttaatgataaaatgaatatgtaagtgccattttttcagttacttcgactagaagctagtgagtaacacacaaaggcataagattctcaggacaaatatacatttaacttttttaggaaaggtaatttattttgaagtgggattcatgtaaaatcttaacaaatttgatcgatgagatgaattatgcacttatgcttcattggccctatatttatataaactatgggataaattatggctgctatgtgacagtgatataaaacattattcctaaggaacaatttttaatcatgggtctagtcaatcttgtcattctcatctttatttctgaaaactttaaaatgtgcaaatcttaagatacataaagaatggctaatgttattaacgcataattaatatgttttgttaatgtacaagattgctaatatctcgacagatcaacatatattattcgatgttttgcataggggagctcttataatgatctattttattataaatggtactagactactaaatacattaaaaaataaaacggtgaggaatataataagcttgatcggaactaggtagatactatatattatgtattgtgccaaattcgacataaggacatgcgtatacaattagttattatagatatagaaatttgtgagaatacgtgacgataactgtttatgtttataaaatatggttataaattaggtatgcatggaatggttatgtgcttagctttactttttggatacgaaagagatgaattgtacgtgagaaaagtactagagggaaccctttgtcacgtgtacttctaataatctaatatcatatgagtacattaattttagtgattaagtaaatctgcatggaaatacacatttgatatatataaagtgaaggctggtaaataaattcccttcatgtcacgtttcggaccagctgttccatatttcattgtctctcttttctcatatttttggtccttaacaaaaaaacaaaaagagaatattgcgtttaatgtatataattatccctgctatatatatttatattatttgggatataatgaggcgacataaaaatacggattcatgcttaaagataacactagttataaaatctcacagaaatatataaagattcatagcagaaaataatttctctctctctctctctctatcctataatgtttcgagtaaagtttgtaaaacatattgaacagaataaaaaccatcgaacatataaagaacaccaaccatcctaactcaacaaagtgataagactctctttctttctctctctctctccatctccctctctttctcttgcttttgttgtcactcatctttgttctctattatagtttccattcaagaaaatcgaatataaaccctactacttcgatcgatgttcatatctgtctttatttcaaccaaccaacgaagataggataaaaacatatccacaaaggctagaaaccatgcgaaataaccattcccttcgtctccaattgtggttccgtacactatttactgttggtgtagtcactcttcttatgatcgatgcgtttgtattacaaaacaacaaggaggacgacaaaacaaaagagattactacagctgtgaacatgaacaactccgatgccaaggaaatacaacaagagcttgaagatggttcaaggaacgacgatcttagctacgtagcaagcaaaagaaaagtgcctcgtggacctgatcctatacacaacaggttcttactactttctcgttttattttatcacttttaactaatccttacccctacctgcatatatgtgtcttggatgtttctgtatgatatttcattaatatataataatatatgacataaacccgtgtgtggtgccacattcatattagttaggtctaagttcaagggctataagcctaaaattctctacaaccccatattagattccgttatgttcaaattatacgcgtggaccacttggtcacttgcatttcgaccatggtgttgtttaacatgtggtttttaccaaggacatgctcttagtatggtctagatataaattcgatattgagattaatgaatgacatctagaaatgactatattagatgaaatcaagcaagctaactcgttgattgtctatatgtttatgcatgttataataagttttgtttcgggtcaccataaatatacttctagcacaattttactaaaaaaacaaacactttgtttcttttaactaactcagattcggtgagacatatcacagaagctcgcaaaaggctgtctgctagctttattcagtctttacgtttaacaatctatttttaattattcactataagatggcttcttttaaaaactttcttttttcctttatggaagctttagccctttgaacactcccttttttttcttagttatataggtaacccacttatgatcacagttaattccatgtagatcgtattaaagtagtctattgactaaatcactaaaatatcaattaatgaattaatgttgtatgatttgttatcgtttatacgaaagtaaagaaaaacaagaaaacatgacttggattaagtaactctatgttctgtcttaatacaggagagcagggaattcaagacgaccaccaggaagagcataagtacggttaaagcttgggtaagaagcagaaagagagagagaagtataattgttggcaaattaatataggtcttgtattgctgctagattctcttttcctttcatttgggatcgaatcttttaaatatgcgcaaaatatttgtgaccctacaattctgttttttttttttttaaatgtttgttttgttcctatagtgaagaaatattgagctagttaggggaggttttaaaaaaatgaagacactgattattaaaaggatttcaagaaagaaaagaagtatacgtacatgcaatgcaatcctgttttctcacgcattgcacgacttatattgggattatttctaatttgatccatcatcaaataacgtttagatgctttatttccttactcacattgtttattgggtacttgcactaaatgatcattaacatttattaagttaggtaaataattgtgtactccttttatgtgcaaaaacacaaaatgggtactattttattactaacatgctttcttatcaaatagcagtaccctatgttgttctaaataacatgctaattcaattcagatttggcagacaaaataacatggtattttagagagagcgcgcacaagtgtgtttttttaaaacaaatgaaaacatcataattacgtacctgattgacccttgtgtatatattcacgattagaaattgtagattaccaaaacactcgcacaaaatggttctatatatagacaatatatgattcttatcacatgttttgaatgaaaaaaaaagaattaagatggattttttttttgtaaagaacaattgtactttgaaagagtcttatccaatcattaaaaaaaatgtcgaatccattatttattgatgtattctgaaagcatatattcttccaaaggggcaaataaaagagatgtcgacaaagattggatacataagatattaataatttataaatgcaatggcatatatatatgatataatttgagctctaaatgccgaaatttgaaaaggagaatgtgtgtaatggttcttacaaataaaggagaccacaatgcttctttgtgttatgcttttttcccatcttttattcttttgttcttttgtggggttaactctaccactactcattttctcgctcttttttcacttattttccatatatttctaatttctaaattaattttactaatcttgaaatacaaaaaactattagacttagcttactaatttactacaccaccaacatacacactacgcaacatatgctaatatgtattaaaatgaaaagaacaaaaaatgagaaccggtattacaatttatcgtagtgtatgactagttatgagatgagaaggttcttgaaaaaagaattactaaccaaataatgtagattaattatttgcaaataaagaaaagcaagaatatatagcaaaatcatgagtttacggttcggctctataaaatcttctacaaccatccacgataaacttgatacatgaaatgtcttcttccattaaaacatgagttccacatataaaatggtttacaagtaactctcgaacatatgtgcatggtaaagcaaatatataataccattattttttctgtcttaattaagcaaaattaaacatatatataatatatgatccctacatgttcacttttaaagttcacaatttcaagagtttgaatatctttaatttgaattattaccaaacgcattagacagactaaacagagacataataatcaatcaacttctttttgtcttttttttttttttttttttgggcttccagtcttcataatcaaaagtaactgaagaccagtcttaaagctggaacatttgaactaaacatatacgactgctcctatcgctctagaaattttaattaacaattattcatagttacttaattacaaagacaacaataaaggtgaacgaataaattaaaggaaaattatgaaaatagtttaatttgtatgaaacttttcatccgcataccaaatgtcatatactcttatcttacatttttctcttgggacatatttttggagcgaacactttcgcatgtacgataaggttcagtggtctgagcttcgactacgttaaaatgatgattagggtttactaatttggaattaggagttacatttaaggttaaaagtttatgagtttcaagtttcaacgaagctttaaagtttaaacgatggttaaagttttatgattatggtgggctatgttatagttctttcaatttcgttgggccaaatgggctaaacgattaacgaccctatgaatgggcctgaaaaaatgaaagccacgtgtcagacccccacaatggactttgactcggtgcggctgccggagagaataattaattatcaactccgatgaaaagaaaacaaatacaaagttccaacaaaaatcgaaattcacaatttctcttcttctaaatccatggagtgatgatgatgatagatagattgaatccaaacacaaaccggatccgagattaaaaacaatccggattgtttatatttactttagatcggagaaagatgccgccggcgaccggagatatcgatcgtcagatcgagcagcttatggagtgtaaagcgttatctgaaacggaggtgaagatgttgtgtgagcacgcaaagacgattcttgtggaagagtataatgttcaaccggttaaatgtccggttaccgtctgcggtgatatccacggccaattttacgatctaatcgagctttttcgtatcggtggttcttctcctgatactaattatcttttcatgggtgattatgttggtgagagtctctctttaccttatagctttttttagggtttctacatttctcacatctcttgatttggatttgggtattttccctaatttggatttgattttgttgaccttttggggctaatgtagacttatttggaagtgtttactagaaatggatagattattgtttatctatcgaaaagttttggttttggaagattttgtcattgaaaagacgaaacttttgttttagctgttaactattctcagggcttctacaatggagtagcttgaccttgggagatataacattttaatgtagtttgtgaagcttcatgttcgagtactcggatttgtgtttctcttttctctgtttaagtgccttaagctccgtttcctacttaagttgctcaattagctaactaatggatcattgttaaacttgtgaagatcgagggtattattctgtggagacagtctcacttttggtagcactgaaagttcgttacagagatagacttactatcctaagagggaatcatgaaagccgtcaaattactcaagtgtaagttgttttctctactaagttttgtattataagcttctcagcctctctcaaaatgtttcttgctgattgcttacctttttcaggtatgggttttatgatgaatgtttgaggaaatatggaaatgctaatgtatggaagcacttcactgatctttttgattatcttccacttacagctcttattgagagtcaggtatttaaaaaactaatgagcgttttcactaccttagacaatctcttctctgtttctgctgttttggacttgactacagaactctttttttctgtaggttttctgtttacatggaggactttcaccttctttagatacacttgacaacatccgatctttagatcgaattcaagaggttagttccagaatccaaaccaacaaaaggatgcaccttacttgatgtttacataacgagactaagatgtttgtgttgcctctaggttccacatgaaggaccaatgtgtgatctcttatggtctgatccagatgaccgatgcggttggggaatatctcctcgtggtgcaggctacactttcggacaagatatcgctactcagtttaaccacaccaatggactctctctgatttcaagagcacatcaacttgtcatggaaggttttaattggtgccaagaaaagaacgttgtgactgtatttagtgccccaaactattgctaccgttgtggcaacatggctgcgattctagagatcggtgagaacatggaccagaatttccttcagtttgatccagctccacgtcaagtcgaacccgaaaccactcgcaagactccagattattttttgtaagtaccaaaagaactaaagctgcaattccacacactagctcttcgtctcttttgcttctattcttaaccactttttgtaatttcatattccttacgtctatttctgtttgttaaactctccattgtcttttaaaatccgtaattttttgtgtgcaaagattctggtccaagtaactgaaaccgctatcaccaaattctattgaagccaactttgtacagagaaatgatgatcatgttacacagcaaaagccctagctaggtagatataaatatgaatgttgtggagaggtacagacaataaacaaacaagctggagctgagatctaatctatagaaaaacaacactcagatcaaaataagatgaatcgagagtttcaagagctttctagttcgctttggatccaatcttgtgcacacatcaaggcttgcacggtactcggtctaagcgaacgccatgtttcactaacccgtctcctttgacaagtttcaaaggcgtcttcttctgatgatacattcaacattggaactgctaacacgttacgtgccatcatggagagaattgggtacttaggtgtgtgaactttccaccagttcaggatgtcgaaatctgaattccggggaaaaagtggctcttctagatacttttctagatctgatttagagtcttgacccggtgtagtagttgtttcgttaatgtacctatcgaattc

SEQ ID NO: 535 - DNA, 87768 bp, Arabidopsis thaliana
  Arabidopsis thaliana synthase
tataatttctgataagaccaggttagatctgcttcaaaaagattgtattcttagtatataatgaaaagttgaacttattgtcacctctattcaaaagatcgagtaggattatcacaactacacagtggtggtgtaaacttattgaaccaatttatctttattagtcagaacatggcaatagaaagctaaaaccagaattctctcggataagaggtggtggttctacatctccgatctctatccgctccatcgatttcgacaaatcatcaaccgagaaaggaatactgccaacaacaacaaaaaaatacaaaatccatcattcatgtacatagttgataaaaggaaattaaaatatggggtcgaatacatgagtgagtactaacctcgaatcgtcatccagtagaaaagagttgctaacagcattgtttgaatcttctgtcattagtactctcatatttgctatcacctatcgtataaaatacaccaaagattggcatctttcctgtattatcatcatataactcaaaacagatttttcaaacttacgtctggtgatacgctatgagttccatacttgtcgtcccaatacatcgtacttattcggtatagttgttgtatgctgagcacctgcaatttcaacttcatatttcatcaaactgtccacatttacttactttctaaagatcaaacaattcattcacttaccggacacagctcatgacttatctcgtccaaggtttttttaggtttttggtgtatgacctgcatattattacaacattaaattactgcattttgataaaccctgacagagactgactcttgaggtttacaagcaaatcatgaaaatgtaccagaaacccgatggcctgtctgatatgcttcagctcatcccaagaagaacccgcatattcatctgttgcattgtaacaccagtgctccagttcagctaatcctgcttttacgtattccccattgctaaatgaacagcactcccgtcttaacagaagactgtaaggatgatatgagaacgcattattaattgatacaacaaggcaacttttgagaatgagactggtaatcaacagacctattaaacagttgaacattgatgaatgagaagatctgcgtaaacaccttccggaccaagaatggaggaacctaagaaaaagagtcaatgaaatgatttgaagtcttggaatctctcaaacaccgttttttataacatgactagattaggaactcacgtggttcgatttcagattgttgaggaagttcgtgaggctctttacaattccttgccagtgggcgatcaatgcttgctgtgctgcggtgttgccaacagaacgagatgcccctttcactaaactcgctcttgaggttcttggtgcctattttatatgaccaacaaaagaagatttaaatccagtgaagaaatgcgcaattgcttgaacatgtaactgatgtattgccatatatacctgaatgcacaatccaaggagtggagaaatctctttcttcaaattatcacgaatcattccgtatattttctcaacataggctgttagctgttgcttgaagaggagagctgggtatttcgcctcaacttgccttaaggtatcaactccaccatttatcatggcaagattcacaccttggggtgtgccgcgaaagctctagagaaagattgacattgacaagttaaaacttgtgatgcatctgatatgatgaagtttatatattagttggccacacacacacctgagtcatcctcccaaagagagtggcagaagatgagcgacggcgctgtggagccattcctgctgctccactagctttaagcgtgcgttggaggagtaaaagcaatgtcgaggcattggataaccaatatgctagtatattgttgttgtcttgcgtctgaatgagaaaaaaaatgcaatcactaccagtccgaaatccataactttcattttcgtatctcaaaatagtatagtagcacaaacaaacctcaatagcttgtcctattgtctgaatgatcctatcaaagacactagttctttcaacttcaaatgaccgccattgcaataagcatttgtatatgatacatgctgtaacaggtcgtttcccttggaaacccaaatgttgaacgatgcagcgaataagcagctcttggttttcttgctgcttctcgtttagtgatttctgtggcttatcgtccacttcagagagatcccttcggttaattgaatggctatgcaaatcctgattcaaattaaatgaaacccaaatagaagaatagcacgattaagagaactccacaaaacatgcaagacaatatttgttagacatatcgaggtacttaccaaacttggccttgcatcaactgatagatgaccactttctgaacctctctgttttgtttttatgcacatatggaagtcattaacttcagatagaaaaacaaaacaaatggaggccaacagttttcttggtatattatccgtacctgtaaaatcgacctggaccggccagagagaaacttatttggtgcaatggacacagcttgttgtcgtaacaccttattctctgattctaaattgttgcatttttcttccagcctgaccatcatgattacaaatttcagcgcaacagtgtcacgaatttccattaatacatgtgaccaagatctataccattatttacttcctactattaagaaattaatgatttgatattgacttaccttgtcacggactcttggagctgctgagcttttttctctgtgtcttccaactttttctttctgtcctcgctagactcttgagcttcatcaaatttccttgttgcatcatcggccctttgtttctcttgttcaagattagcctgttgttacacaaatgattactaatgctccatacattattctgcaacaatacactaagagtcgaattcaggcattttaataaccaacaaaaaacctagcgaaaggataaaccaatctgatcgccaatgaatacgagatttaagtttggacaaggagggagtacctttagaccctccacttcttctgtcaatgcttcaatcttctgggtatcttcaactaaaacttgcgtttctgttacaacaggaggcgcttcttcaatggccttcttagcagcttcacgttccttaacaagaagcccatttgtttcatccactttcttccgcatttcctctaatgaactctgcagtttttttatctcctgattcttttcttcttccaggtcaacctgacaaggtttattatatgtttgcttcaatatcatcctaccgaaaacaaatatatttatcaatcaaaatcatttttctgtatcaaatacccttgagcgtttctccaactgtgcacggtatgtgagttcttcgactttcttttcgagcatatcctttgcctctttcagtgcgcctgtttcccttgaagcctgaagataacaaaaagtgttgatgagtatgcttaggataatagtttaccagaagatcacatacatggcaaccagcttatcaataggcaaaacatgaaagaaaaataaagaactctctatttcatcttcaaaagtccctaaaagtggcaattacacagtgaacgtacaaagtgcacccacgtaccattttgagctgtcgaagttctctccttgcaagtttgcctctccatcgtgtctgagacaggatcactcctttcttaagcttcttgaagtacaaagttgctctgtgacaacggaactgagcctgcaatttataatatgttaatgcgttagtaagaaaactcccaaaattagataagctgaccaatgtatattcccacagatatataaacctgaatagttgtagcagcctttgtttgcttcctgaatctaaactgtttatgagcagccattgctcttaaacctgtttgtacaacaagcgccgctacatggaggtttttgtatgattttctagaatgtaatctccgagcattcttctgaatcttcacagcagcagcttgtcgtctcaagttatcgaaaattttggaagaaagtcttcctataattttcgcaaagaatagaaacttattaatcatcttatatctagaaatcattcaatcaaactatgagaaaaacatttttgcttctaaattctaaccaagagaaagtacacaagagagggattaagagactataagatgaatcagatggttcacctctgcataaggcttggagagatatggtggcttttcttagtaaaatgaaccgtctttgggcctgatgagtccgtattcgtctctgaatttttttggcagcagcactgagaaccatagttcttctcgcgtcgagttcagccatctgacccgcccttaaaaacacctttgttttaccaacctgcattacccaacgatcattgaaccatattccatggcatcattagtattagataatggttgaacgaagaaaaagacacttaaaatcaaaacctggtatcctttgagtccaatattgtctaagatcttttgcgctgcagccttctcctcgtagctgttcaggaacaagcagtatacacactgtttagttccaagatatttgttataattggatcaacagaacgaaaggattcacttacttcccttctagagctcgaggatatagaagtccaaaacggttaatgaactcaaagaaaggtttacgagtgggataccccgcacaactgattctgatcgcttccaaaacaccctacacaaatacaaaccaacaatgtctgtttgataaatgaaaatttgtaatactcaataagtctagaacaacaccacagttggaatcatttttcatctattacttacaccacaccgaagttgctgcataatgtttacattctcaaatacggcaggcttcaaaaggttattgggcttcacacatctgatgtagtgaggctcggtagagtttaatgtttccatcagttgctggagttgcaactgcatcaatcgagaaagcacacttaatacccgacattggaatactttcagagaattaagcctatctaccttaaagcgagagccaatggaagaaaactttgaagatttagatgtttcttccgggagcggaggaaagagacccacaacaaaaggacacttggaagcacccaacaaatcttgatgttcagggataacataatccttgtttttgtctagaaatagatcagactgatactggacctgaaatgatattccacaaaacaaaagtactaataagaaacctataagacagttgattgtgttgtacaatgttaagtttcctttgaaggaaaaaagaccctacttctccagcataatgggcaacagcaaaatctgttcgagagagttttggcttgatgaacctcttgtgtgtcttaaaagtttgataaagcttgttcgcaaatgtttcatgggtcgacttcggaaacatgctgaagaaccaagaaacattgttcaaaataagataaaatgaacataactcaagttacatacacaactcaagttgattgatgttaatattaccaagcttcatcaaggagagccacaattccaccaggcttctgcagatggaaatttttctttttgagtgagaaagatgaaatatttagattgcattgtcatttcggagtcccaatttaaagaccagacaaaaatgtgatattgatcagaaataaccttttcgataagatcgagaacatcttggttatccacaaattcaatgtagctccaatctattgcttcttttgtgtattcctcctgttccatcttgaaaacgtgctgaaaacagcaatagaaacttgtaaaccccaaaagcctaatctgtgaaactcaggggaaatggtttacactacaatcaagaaattacctgattgaaatgttgctgcaacttctcatttgtgaaattaatacagaactgttcaaaactgcaggagatcgctattagcagtggaaacacaaaaatctaacggaagtttagttctgaaccttggcgcagtagacattccttacctatttgttttaaagctctcaaatccgtatatatccaggactccaatgagtgatctagaagtcgcatcttggccaattgagacgttgatcttttctaccaacctgcaaataactagagatgttaacttagaatcaaatctgtcaatcaccaatacttgtgtagtgttactagtgacaaaatacctattaaaccagccacttaccaatcaaataaccgagaatagatagtcttagctagaccatctctgctgattaaagcactctgaggatctagacttctcttgataacttcctcaggtgtgaccataacacgtttacacagtgcatcttcaagcgcctttacatcgcacctaaaatgagaggtctagttagtgcatgtattgagaacaacaaccaagtcttctcgggacaaaaatatttacttacatgagaagttctgccactgtgttaagatgaaatttcgacttgtcatctttgggaactgatgaatccacttcttttcccttggtaaattcgacgttgccaaggtggagaattgcagcaaccactctgaaaattgcttcctgttgatttatatagagggtgacggatcaaaataaataccaaaatgcatcagaagatcactttcatacacaagcttacctgttccttttcgctcatcccgacaatatccattgctcttcttgtcgcaatgtaatcatgagcatcacttataccaacaagttcgaagcatttcgactggttcagataatgaaacgtcttgggatgacccaacttgtacttttcgagctcctgctagttctataatgttatgccaagagttttcaatgacaatcagaattaacaaagacttcctggtgagtatacctcctgtggtgcagcacatagaagataaaaacagtggtaattgcgctctggatcagaaatctgacagacacgagacctctctagtagatacgtccttactgcagctccagatattcttccttgcttatcaaattggatttcaacaaatttaccaaatcgactgtgagaaaacaaattaactatcagctcaaattctaacaaaattttgtaagaccacacaatgaattatgcataggttttttcacctggaattgttattcctgacagttttggcgttaccaaaggcctcaaggacaggatttgactgcaagcagaagttacaggcgtattatcacggtgtgtgaaagattatgtaatcaagattgcagaaacgtaaaaggagaatctaaaagacaatccagattgattagaacatcatacttcaagaacttgttgttcaactgtccggccttctgtaacagcacgacctccaagatatgcaaggtatctcataagcatcttcgtggtctcagttttacctgctccactctcaccacttacaagaatagaattgcttttgccctcattgatcattgccctgaacgtaaatatcgcatctcagcttacaacacaaaccacaagtatataataaggttaaaagctgacaaataagagcacctgtacgcaacatcagcaactgcaaaaacatgaggacttaattctccaaatggtgctcccttgtactgttgcatcatatgggcatcataaatatgcggcagtcgttgaaatggattaatagcgataaggatatttccagtgtacgtctgtcaagacaatgcaagaaactgtcaagaaaggcagagtcttaagatccaaaaagtaaagaaaaaatttaggtactaacataaatttcattaagttcatatctgatctttaagttctgaagaacaccaggctcatgcaaataagatagctttgtcatgtcatcaactccacctgcaggtgcttccatatcttttgggtatatctttgacaactttgcagtgatctacacagaaacaaaaaattagcaaatcagcttcagtgtattccaggcttcaattatatggaaactcaaatatgtttttaactcgccttttttccgtttgtggcttgaacctcaacatcttgtccattgatcttttcaaccagaccatcaatccaagccacatcagaatcttcaatccaaacatgagagcctacaatgatgttaaccggagttccctgcaattttatgaacaaagaactagcgttttgataggcgatctacgacatttagtaattagatactcaatgtgaataccgagtaatatactaatctaagaacagagtcactgaatttctcatctcattgttcttccactcttagatttcaagcctacatgctactaatcgagaaattgaaaaatctccggttcgaatctcaatgttgcataaacaatattttaaataaatgaatgaatgacataccatttggaagcttcaaatgcaatgctcagctgaatgaaaccctatccatgggtagatttcacagaaactgacttgttacacaaggaagctataagattatgtaaattcctaaataaacacatcgagaaaccccaaaatcacaattcaacaccactcaaattacccaaaaacgaaacgaaacaactgcataagtccacagagcctcgagaattagggtaaagcagaacaaaattaaacgaaatcgagtcaccaaaaaactgagattcgatcgaaagaggtgtagaaaacggaaaaaacgggaagagagaatagtgaatgaaaaattcagagagtggcataatgttcttcttcttcgccgagttcggtgtttcttccctacgaattcgcgccaattcgtggccctaaatcgagtctcttctttcgcacacatcaccacactctctctcatccttctctttctcagcttttttaattttggtaacaaatcacactctcaattttttcaaagctaaaattgattttagactttggttagctcacgaattaaattttttctaattatttactttgaaattatcacgtaatatgaaatacattcgagcaagaatcaagcaaatgtaaatttatgaagttctttcactcgagtaaataatgttttcatctatataagaaatggaatatacataaaaaattctatacgagacattatgacacaacaatttttttgttttcttttgtgtatgtaacaagactaaacttacccttttttttttgttcgaatcatggctcgaaagatggaacatgagttgcggtagtgtgcgtcaaactgtagtttaatctgtctaagacacttctgtatggatcttcctctcgtttcttcaacaggtaggctatactattctctacctccgcctttacctccaagtaaacttgatttgcttcttctttgtcttttacaagctctggtcttccctttgtctctatcggtttcccaaacaggtaatagaacctacccgggactttcggtatgagtcctggtaggtagagtggctggtttgccacctctccctctgactcttccctatcatcacaaacaatagtactcatcaatctttgactagtaacaactacactcattagcatctatttcagttatatgaaaaacaatgttacctcaatttaaattgtttggtatcgcgagtaacttccgtgatatagtcattaagaatagggatcttcatcaggtcgttgtaatcaagaaccaactgcaatagcaaaagaaaaatatatttataaatgactattttcaataactgagcacacgaaattcaaattttttgggaagtttttctgtgacaggaagcttacttcagctatgtcgtcttcaccaactgttccaaacggcactattgttgcaccaaaccgtgctgccattcttacaaactcttgctgttcaggccaaattagtttgtattgttcaccctgcaatgtcatagaaagtagtatatgtatcatcagaaattctaacaacaccaccaggttaataaattaagtacacacttctattaggacaaagaaacagaagatctcagataaccaaatcattttagtattatttgagcttaaacaggttcaactgcatagtcaagactttgatttcaccgtcaagtgggtggaaccactctccttttggctactaatttttcttaaaccaaactagaaaaaaaaagaattgaaagatggctaacccggttatggagagcctctcgtgcaccaccagggaagagaaggacatgagatttagaatctaacagcttaaatagattggttgcggtgacaggataggcaccaaatactttaatccagtcaccataatcaaacgccttagctggatcattatcagaatacagaaccggatgggccattccacgaaagagaatgttcttctcttttataaacgcctcggacattggaccaagttcaagacccatcaacatgtggtaaccaacaagtagcaccggacctttatctggaacaccagcaagtcccttcactattttcccgtcttccatagttgaaaaaaacacagaaccaacagcatttcgcaagaatctgcatatcacaaggaataaaatcagaccagataaatcacatgaagctaagtacatttggttctcttttgctcatttgaggagatcaaggaacgagacacattaacttgtagtgtcaactgttttggagaaagtttttgaatatttagtagatggaacttttttctaagagaaatagagtcaaggaaggcttagcaaagttacccaagcacttcatcaagggcgtaagcaagttctcccttacttggaggcaagaaatcagaaaccaaatcatatctccaggaccgccggtacttgcctgtaccttttataactgtgagcaaactgatgctatcttcctgggacaataaatggtagtatgtcaatgaataaatagtcatactactctgtgtttttctcttcttgtaagaaattactctaatactacttaatagcttcacctaccatccggaacaaaaggaaactcaagagtaatttagtatgtaaattactatgttaaattaccaataaaagggtatgcccattgtccttgaagcatcgaactgaacagtttttaagtaacccgtgaagccgctttgcttcttcttggctaggaagcatcatgtcctttccactgaaagtcgatgaaatccgaagtcatttctattttcttgataatatgtcgctcattgtaagccaggttgtggtatttctttcatagaccacaaataaagaagagagaagaaatgttataccataagaaagaagattacctagcaaggaccaagacttcagcttgaacagcatggatgcgggaattggcataagcacagccagatctcagtaacttaagcttccaaagtaaggtttcccgtggaataattccaccgagctcctgaaaatgaatggttagaaaagatgttatcttttatagaaacagaacaaagtaaatgcatttaaagaacactcacagagagaagcgggagcattgttttagtaagcctttgtctcaacttttcaatttttactcctgttggaagttggttgtcgataccaagtgtcgccatctttatcggatcacctataaatccaagaaagcttaagtaaagacaatttaagaagacaaaaggggacttaattaacttatacaataaacatcagttcatgtacccataataaagcttagagcatatggaacagtaaaatgaagctcctctggcaccatctctaatataggcagcaacggctgtagcggtgacctatcaaatgatgtagctaaaaaaggagaaaacgtgtttggtcattcataaaagcttatatgcaagtatgcgtttagatacaaagctacaaaattaaataaatgtttgctgacctgggttgactagtatcaacaccaagtctaacgaacggtttctagcagcaacagcaagagccaggcatcctccaaaggaatcgcccacgagatatatcggcttattaggacgtgtagcctgctcctgcctcaaaacatcttcgactactttcagaagccctttatggtaaaaccaacagaagagaacattcagagaaaatcaagtaaacaactaatgaccttatacagaatcactagttagatatttctatccatttggaagtcaatattcatttgtaaaaatcttctatttgatgtcaaagacaatgaactgagtgcaagtaatctaagtattgttgtatgtacatatatacttgtagaaatgtatttatacacagcacatgcatctaaaagagaaaacacaagccagcgaagaactattctatgatcttaaagggacagctactgtataaaatcttcataaccaaatgtatatatcgctatctttttattaccttcaaatggagttcgatcaagtacaggaatatgcaggcacgagacatgaaaagccctgtattgaggaaatacaagaacaacagtttagactgcaaacacttgtgtgattaaaaacgagattcaacataatatgaagtgtcagtttgtttggattagttttcttgcttctgcattaagtattcaagtttatatatttacatttccacattcttagaccaatgtcatttccagagaaactagacttaacaaaaatagtgaacatacttgccaagagctttgtgatgtggaacaaggcccatccctgtgccatccatccctgcataaaatattaatccatcaggcattacgaaagtccaaaaattggaactttgaagcgataatcagagagtcagatacttgacactgaaaaacagtaaaaaaaaccattactagaattcaaaatacagcctaaacaataaagcattatcctaaaagcttggaactttgaaacgaagatttagaatcagatacatgagataagaaaacagtaattcaacaaaacagcctacagattcaacctttcctccatgaaacacacaaagaagtgagaaaatgaatacaaagtttcaaactttggaagaatagtaaatttttagctcatgaagcacacacaaacctcacataggtcaagcaatttcaacaatcaaagctcaaaaaccattgattcttataaatcactgattttgttttaccaggtaagaagagtaacgtaggagcatcttcaacaggtcgaccacaatcaacgggactaaaccaccgtggaggaccaccatcagccttcaaaatctctttagccgcagcaaagtaatctttaacagatttggagccatacccatcatcccataacaactcaatttcatcactcactatctttctcttggatttccctttcccattcacttcatttgcccctttttggttttgaacagtagtagacaaagagaccgaaccgttgttgttcactggttccaatgatgtcgccttcttgttttcaccagagatttgagctcttaccttgaaattgcgtctttggttagaactcaatctcaaatttggtaacaccaataagcttgaagaacatgttgccattgtcttttgattcaggcagtccacaggcaacgggaggagagatttcttagaaacgattaccaaaaaataaaaaataattttaaaaagattgaaactttaaaaatatcttacaaaagtttttgaacagacaaagcaattttttttaaaaaagaaagattattaatatttcttctttctttcggtttcgttttagaaatgtatttcatagaaagtgctaaaaataataaaataaatctttagtagaaaagaatttttaaatttccatcggacttcaatttcaaacctccatattaaggaagtggggtttacaagaggtagacaatcagacacctaaactacttgaaacggaaaaataaagaactttgtattctttcttgtgtggtgcacagaaaaaaaaaagtattatgatgtctttatagcaagaaatctgtactgcaatacaaaatgggaaaagacaaagcatttgtaataggtaagttttaaaattgtaatatatggaatagagaatgtttttagtcaattgctaaatgggtattttatacatgttaaatccaatatgtatccataattatgatctacaaattaagaagaagaaaaaaatattcacttaactaataatataattaataagaattttttaatatttaatatctatctcctctaaaataaaagtaagaaataagatactaaaataactaaaaaataatttctgaagtgactcagattcacattctataaagaattttttacttttttcttttatttttgaaggtacactagaacaaattgtatgaagaaatatatttcaaactacgttcagagatgtctaatttcacatataaaattgaactatttttcttttggtttttatttgttcttggagtcgttatcaagattacgcagttaattcactagtcgctaaagaaacagaagcttttcactattgtttatctattattccgtctctctttatgattaatatctttttgtttttctcataagattaattctttgtatcgctaactataatgataaacaaacaaaagttaggtttggtgtaatgtgtttgtagtgggttaggtcacacgaaagacgtgttcaaataggttccgcaaggtttttaacggtaaagaaggaagagaagcaaagcaagaagcatagattcttggatgtattcatattccttgctttaagtccttccgtctcaattttaacaactatggtcacatgtccatactgatctcgtaccatgcacttgtcttcacatgcttcttcattttctatttttgggtattcgacaaataaatcgtgcatggaaatgaatgtggtatcgtccaatgcagtttacgagataatatatatatttttatttttgttaaaaagtaataataatacacaattaataatatattattaccaaaaattataaacaaatattaattgcatgggatgaatttctggttgttgatttgttggttcagactaggtttgtattcactagagaacttcaaatatgctgaaattcgaccactcaaaagcaagtgagactctaattgtcaagggaaatagaagacgctttaagatcggatcgttgaggattagcttgcatgaagtctgaagatatcttcaagaagggactttgggttgggtccgccatggtagtgtttttgtgacttacaccgaaaatctttaattatatggaggaatagtaaatcttgctaagtaatcccattaacttattaattgaatatatttttatgttaataatatttgtcctaaacgaaaagtatatctatttctctaatcatcaaataaaacaatgagtataagatacttacatatttaatttgtttttcttgatcttaaattagaattattaattgattcttttagtttcaaatatcatgcaaatatagatggcaaaagattcgagcatataaatatggtacttcaaattgtgaaagtacgatttgattttctcttttctttgttgtacgtatgatattaaaagtagaggaatatgattcttgagtgtagaatcttgccttctaccatggttcaagtgtaagcaatataaaaaagggagatgtgtgtttatttcttcccaactttgatactcacaagacatctttttaattcactcccttgcaaaatggtggatcatcatctcaaagctgatcgtgtagttgctcgggtagagaagtcggtcaatttggttataggtcataggcaaacacaaaggcaggccggctcaagggagtatgaaggtgaatcaaagcagaagtacacaactaagaagatcccaaaatggaagcataatgattcagagagaaagataggtcaaaagcaaaacaatgaaacaccaactatgattgtcgctggtggatgggtcaggccaaatcgagccatgtgggcttcacctccaaattcctcgagctccaagccacaaaagaataattaattattgagagaagctggtggtaacatatataagaactcaaattaaatgttcaagttgggaagtagacaactgttgagcgagaacaaggccagtcgtttcaaaacatccattaaaaactcagccatggagggtgtggtggcatatatatgtgtgtagactctagatgggtgaattttataagtttattacatgtaatattacatcatggaagttgatatgtctatatatatatactgtatattgcgtgcctttgtaatatatagaattcaataaaacctatcttttttatttatttatttcttttttggtcagacatttttttaaaattcgtttttcaactattaaaatgatttaaatagatacatatatacttaattggcaatccataaaatagttgaattgttggaattataatctgaaatcgtacccgaaaattcaggtacgaggcatattaaattaaatatcctaataataagagttttgggcaacatgtttatcaagaaaattgaagttgtatgaagtgtatgaactcaacattttcgagaattttagtcgccatttgccatatataattcaacttgtaacggatcgtaattaccacacttaccattctctgcattagctggtagttcagatcgaatatgttgttatataattttatttttttaaagtgtatttgttactacttactagtatatgtatatcattggtgtcaaaaccatatagttccacaatatagagattttgtcttcatgtcatcagttgaaagttgaaccacacttactttttctggtgcaaaagtaagataagaaaaacatttcacattggcaccaagagatgctatattgctttttattcacaaatgtaaattgtttttcaggtcaagagcgaaaattcctagacatatacctttttttaaaaaaaagtctatcacataagttattaattaaaaatatatttaattcactaaagagaaattttgtcacaaaataaaaagcagtctaccataagctaaagccactaagtttacacctcatagacaaacttagaacctgaaaaaagaaaaaactcttctcagttggtttttctcttttcaagagtcgaagtctcaaactcttctcagttgctagccttgttagccttcaaagaaagctgctagtggtgtaaggtctttgttacactggtgatgaagaattccggtgagacacctttatatagtcgtggctgggtttaatgaatagactttcactcaaaattttgagattttcggaaatttttgactagagaggttacaaatgatccagtttaaataagcaaaacaaatgtagtaaaccactattgaaaaagtgttatttcggtttatttaattagttagattgtaatattgcaaattttaaaattatctaaatgttcgttattttttcaataacatacaatgcgtgagttcaaatgttgatgttattgcaataacaacactaacaaaaaccgctaagattatgacccatgcacattaatacatttatgttgagaatagtctgattattaatatttacatgttattcaacatacaatgaaaataaaatggtaaaaatgtatttacacatagtaaattgatgcgtacaaaatgaatgtaaattgattacagacataacagaaatgacaacgtaaactttataataacacaataaaatagtaatcaaaattatacaattgcacgaataaattttctgaaattgttttcgtataaaaaaaatttaaacagtaaaacataattaaatgtaaaaaatctttgtgatttttttttttgtaaaaagacgtagtagaatttacaaattaaatttaaaaggcataaaatgtataaacagataaaaaaacatataaagatttcttaatattttgcattttgtttcttgtcaataggttttattttccaacctgcatctgccaaagcacccaactccacctgacttgtctgtgtctgttgcgttcactttcattggaatctcagattttttatttttttgtttgttttggttgttgcgagtttgtgactataaaacctctcccacttggttcttcactctcactgtttctcatctcttcgtcttctccgcctccttcaatctcactccgatctctctacgattcattcgttctatggcttccattgctgcttctgcttctatttcccttcaagctcgtcctcgccaactggtctctctcttccctcgaatctctcatcttgttttacttgttttgctgtagatctgatctgattgattgttgttcttcttcttcaattgtagatctaatttgcagaatcgttttctgagttctaggttgatttgtttaggtggctctatgatttagttttctggaactttggctctgtagatctgatgaatctgttttactattctccgttgctaatcaccggaataattgttgatttctcgtcgaattgaatcacatagattttagttgcttctgtttaacttctctcgtagattgtttcgttattttggtttgatgctttgcattacgagtttaactttgtactgatggcaggcgatcgcggctagtcaagttaaaagctttagcaatggaagaagaagcagtctttcttttaatctccgccagcttcctacccgcttgactgtttcctgcgctgtaagactttgttttttgctttctcgagcctgttcaacaatgtgattaggctctttgatacgtttgggtgattggttgatatatatctccatttttttattgttgtgtaaacaggcaaaacctgagacagtggacaaggtgtgtgcagttgtcagaaagcaactctcacttaaagaggctgacgaaattactgctgccaccaaatttgctgcacttggtgctgattcccttgatacggtatagcttaacaaccttctcgatgtctaataattggattcaacttttgaaatgggattgttcattggacttattgatgcttaatcaatgcctcttaaaaattgtatcctgctttcaagctcatattgtcgaatgttttagattgcaagtcttgtaaagggtcgctgtgtctccttatacgcagctctttagtattgttactgatacaggcaaatatataggacatactcaaacacatacttcacaagcaatgcatttatcaaattcaaaatggattcgaacgtgtgcacatactcatgactcggcgttttggatttcaggtggagattgtgatgggactagaggaagagttcgggattgaaatggcggaggagaaagcacagtcaatcgccacagttgagcaagcagctgcgctcattgaggagctcttgtttgaaaaggccaagtagaatatctttattacattagcaaaaacgaaaaaaatcaaaacccaaaccactatcttattgtttcgttagctagagagcaattgtgtctgttgaaagattttatgttattttggggaaattattacaaggcttgtatctgacttttatctttcttctaaaacattttactttcagccttcatcaaactctcttacgaaacttatgtagtctcatttcctaaataaagatgtttttccctttgcttatttctctgaaatgtttcgagaagtaactgtgaaactcgaaacctcggagtgtaattgctccaacgtaaaaaaacttgtgtgtcgtcgtgggatttgtagaaatgaaagggggtgtattgtacacgaggcacgggctaagaaaaaagactagagctttcattttagcgttaacgttaacaatattgtctcttcaaatgaacttgtccccatgtaaagtgaagttggtaattttgttgttgtccttcgaaaactcccctctcctggtgaagcagcaacttgaaaaagtctttagcattgtggtgatggggtgaaatgtaaatttctccatctcttgttctcatctttcacaagagaagttaagaactagtaagcagtaacacttttattaggatgaacagatactggacttaaaaaggattaaaggcatatagaattaagtttacgctttggtgatgttacaaaaaaagatacatcgtttaatcaattatcttagaaagatttgaaacaacaaaaaacactaaaaaaaaaaaaactgtacgtagcactagatttcgttcagagaaggcatgagccagagtctctcctcggagactcgttcgcgatcagcagcaaagaatctctcttcagcgagcaacgaatgtaaattgcttccgttggctaagctattgaactcaatggatttagaaggcaaagctgaataacgtcgttgacaaaatgtcatcaatcttttaactgactgaagatacttgcgagtggtttcgttattcatgatgtgagcaacactactgctagtagaaatcttctctcgggcagaacgttcgtgaataccaaccatagtcacaccgatgggccatggtgcgttccctatggctagtttgatgaattgagccgttgcatcgaggtaatctcgctttatccagcagttaaccatcaccattaaaccttgacgaatgtcagctggtaaacactgcaaaattttgcttatatatattaaccctaataagacacaaaagataaaaattgcttgctttgcacggaactaaaagaaaaaaaaagatttatttagtttaccttgttccggcataagtggaagagaggagttagatacctagcacactggttaaaagtggctagcatctgtttccctatagcagttctcctctcagtgttttccatagcctcaagttcctgcttccattcaagcaacagcttcttgcagaacacaaggatcttgtcctcgtcgcataaatcctcgaaattagcttcttccaaaagcttcaaatcctccttctcagcaccaatgagctcatcatcattactcgtcttcctcttcctatcattcatgagaccactactcctctcccgcttcttgagctcagtgatgtcacgcaagaaatcgtttgtctctccttgagtcatgtcgttatcgacctcctcgaataatccttccttcaacacgtacttgagtcgatccagccgcacctgatcacaagatttcaatgcctttgtgagttatggtgacaagtattcgaatctgatagagtgttttgcttagaccaagtcaagctaactattgataaaagccacggtggtgtaggtgatacgtcttatttcacatcatggattgatatatactctagtaaagcgtagcatcacacatctagatgttaagtgtctgatcttctagattttgagtatcatgagatgcccctaaccttttatatctgcaagacactcgtatacctaaaactggctcgggtgagctttgatgatgtcgagtttgtttctttacctcttctcaagactatgcatttaaaagataatatgtatcccaatgaagccacttttgagagacttgtctcatcctgttccctctcggaagagttaaagattgttgcatgtttgaagcataatgcgaaagtctttcgggtgctctctaggtcattgataaggcgcattataagaatacgcttttctcggcatgattcgggttcaagaattgtgattgatgctcctcagctatgctttttgagcatttgtgattacttgccagaaagctttagattaatcaatatggatttcaatgccaagttagatatttctcttgccttcccatcaatgagaaaaaacatgcgccgttttttttctcggaatttcgaaggtcggagatatgacgatatggtcaaagactataaagctcatccacgaatatgtgagatttgaaccacggcctcgatttggttgtgtgtctcgcctgtgtgttactctctgtgatttgaaattgttgccatcttttctcgagagctgtccgaatctgaagtcccttgtcttgaaatgggaagctagcttaaagcatttggagttgatgaattcattcggattttcatctgcgcccaagtgtttgttatcgtctctcgagtttgttgatttcgaaacgaccatcttgggatattattcttcagagatggagctggtaaggtactttcttgagaattcggcaatcctaaaaaaactctctctacgtttgcgctattatgaaaaacgacaatatgacatatatctacaaactcatcaaaatcccaagacgctatatcacatgtcatgtcgtcgtatcacactgttctgaccagtttatgtgaagactattaagttataataatccactatcacgaaaaataatccactatcacgaacgtagttattcattctatcacgaccatatcactaatctaaaccaaatttctagtgataagaacagaatgatatatttaaagctaatagcaacaaaagaagtagtgtatatatataataaatatatagttacaaatacatgaaagtctacgcaaatttgaaaagaattaaaacattttctcttagaggaagccacaaagaatagagggtaaacacttacattgttatacatgaagtagtaaacactttctcttctcaggccactactgctctctttcctttactgcttttggtgttatctttcttctttcttgaaacgcctgtgattggatgacccagaggacctgaccacgtctggacttgtgttggtggttcgtctttggaaaaattgaaagaagaggatgtgaaggatgggaccatatctcgtgggataaatgtcgggtctatatgctgtgaggcacccaatggtacacccattgctccaccatcttggtgtggtggcggaaacttctcgctcttgctctttgcatttgcgtgtgtgattaatctccttctctgctttttaagagtcaaaagatagaaatgattatgtaaaaaaaggatcagtctttgtgtgtgtgtgtgtgtgtgtgtatgtagatatgctagaagcagaacattagtgaagaatcactgtcctagaagcataagcactggtggtataaaaccaatattcagcttacttcctaacgtagacaatagcctaaatgcaccagtatatacagtaaaacctatctataacaacagtactcacctagaagcaacctgattcgagtcagaggaataaatgtagaaaagaagagacgttatcgaaaagaaaacagttgggaaggacatacatcgacatttgactgaagttctgcattagcttcaggagctggaagagctcgatttgaacgatctctgtgccgattcttccttgcaccatccccttgggctttactagcagctctttgtctgcacaggagaaaactgttagtctatgcatgctgacaaatacagtataaaatagctacaagtaatggtaaacgcaacaataatatcggaatttctaaaattaagcatgctgacaaatctggatggtctatccagccaaagttgaagcctaaattggtatctggtatggtcggaaaagctctccattaagaaaatcgagaggcacaactaaatacgaagtgggacatgtttttttttgtggttcattcctacccggaaatagtatatgaatcatgattaaagtggagtacaccaaaatatacataacatttcaaccatttgcatcttcagcaaaggtcatggtaagattcatatatgctgaacatgaatattcaatcatattggcatgtcattcatgcccgaaagaattagaaatgtatttctctagtttcataagaaacagacgctatcagttgaggttagcgatgattaaaacactacagagaaaatgttacaaacctccgagtttcttcatctcgtcgctttgcatcaatttctttgctcgggggatactttggcagatcagcaggttcacaggcatatggttcacttgtaaagaactggaaaggaaaaattgcagagtaaacagattcaaatctgctcagcatcatcagaacaatttatgtaaattagcagaaaaatcaaacctaagaacttacttcactttttaaagcagcagatgcagtttggcggtcttctggctcgattgaaagaagagcgtcaatgagcggaagagatgatggtggaaaatctttaaatgtctctcttatgcttcttttgtatggttcacggggtttgtatatggctccatgtgtgaatttcccttttttccaataatcctctgatggtgaaccacacagcttgtaaatcttatgtagctgctctacctatttcatgatgaacataagcatgcatacaagcagattttagatactagggaaatagaggacataacttgcatatggagggaaatattaagatgatggattgataagatacctctgtccgaccgggcataataggtcttcccgccaatagctcagctaaaatacagccggcactccaaagatcaatacctacaccataatcagtagccccaagcagaagctctggagctcgataccatagtgtaaccactcgactagtcattggccgcttgtgattaggatcaaaaatcgttgcgagtccaaaatcagcaatctttaggaccccaccatcatcaataagaagatttgatcctttgatgtcacgatgaagtacaccacgactatgacaatgctccaaaccagatatcaactgacgcatcaaacatttaacctgcaacgtaaaagagtaatctgatcttaaaaaacgactgaatattattagcctataaatttagaatgcgagatactaaaacgcctaactaacctctgattctgagaacttaacaacaggacttgaagcaagaccagccaaatcatgatccatgtattgaaatacaaggtataagctacaagacattcttgacgtaaccaaaccttccaacttcacaacattaggatgatcaagtctccgcaacacaagaatctctctcgccataaacttcacactttccggctccaagttatcaaaccgaaccttcttcaacgcaacgattttaccggtcaacatatccttagctttgtacacattactatatgttccttgtccaatctaccacatcaaaaacaagatatctccaaatgagaaacttcaaaaacacccaaaacaaaaacagaaagaacaaagtaagagtcttttcatgaatcaccttatcaattttctcaaaagtatcagcctttctaggaacccaaccatttaaagcttcaccacaagcatcagaaagccaagaaggccaaccagcagcaacctgttcaccacgccaatgcttggaaggattactcaaccgcggattcggctttgtcgaccttcttcgatctcctttggatgatttcctttctttatcaccatttgcctcctcattcttcttcttctctacatcatcagcaataactccattactcttagtcacactactctctcctactactactactccactactagctttagagctcttagcttgtttagcttcagctgttgttgttgtcgccgcctctcggccaaatacacaacccataacttaaatctcaatctaagcttcatttctcaccataacttctaccaacaacctacaagaaaaccatcacaactatataaaatgaagtcgatctaatcgaagaaaacgaaaccctaattaatgatcttgaactccattgaaagaaagaaaaaaagtaggtagaagttgaaatacgaataaaaacctagtttccagaatctgattgaagaacttttggagcttgaaactatctctatggtgagagagaagagaagtaggcgagcgttttttttttttttttggttgggtcttactgatttggttgagacagtcaatttaatttccttctgtttttaattcttttttatttttcttattaatgaagatgacaaagaaagaagaagaagaacgcagatctctcttcagttcagggtcaaactcagataattaattaaatataaataaaatagaaatgatgtagaattgtttttttttttaacaactaaattagtaacagtaaaagtttttatgagttgattttttattttgaattactaagaggttttatgttcaaggtcatatatcttcagctatatacaagtgggactaattggacataaaaatgaagaatgtattaacatctcaatagtcatccataactaaggaattgaaagcttattttcggatgaaaatttaatgttatgtgcgtattctcaatttcattaatcgttcaaaacagataaaataattagtattataccgaaataaaaagtgacttgattgtttacctaatcacaaaatttgcaaaatgacacagacttccatatatataattgggtcttgttgattttttaaaagtttgtaaaatatgttctagagaagtagtagtgatcagcgttatttcaactcttttttcgtacacatgttttgtaggaattgtttgatgcatatgtaacccccttgtcgcgcatgtgtaccttccacatgagtgtattgcagcagcccaaaaggaacatagtacaagacaaaatgcacaaataacattctaagaacttcatgtacaaaaatagaagcgctggtatcaattttctacttggattcttttttgtcctttacattgcttaaattgttatctaattatcatctatgtatacatcttgagagagagaagacataacatgtatgtttgggacaaattaaaaactttaattttttataataacatgtttcatgtaatatcattgtaaagcatcttatatgttctttatatctattctgcaatagattttatatgtaatgtgttcaacaaagcaataaattaaaaagctatagaatagtgacgctatgttaatatattttttaattatagtgacataaaaaactataaataacttcttagaaagagttttttatctactgtgctaatttgttttgtatataatatttcttttattgactattattgttttgaatgatttctttaaagactactaaaaataaactcgggttaacatccactattatcttttggaatgtctttatttttgttgaaatgttatttttgtcaatagtgaaacatattgtaattgttgtttattcaaatgttctaggtatttttttttttaaaaaaaaaagagaaataggcagttgcacttcttaacacttttagaagtatgattggatataaaaatataaaattaaactgtaaagacttttgtagtgaagtaaaaattctcacatcccattaacaatcaccccagtaaattgattcttacattatttttttttatctaagtttgtatatatagacttttcaaatctatgtttaattcacatgttagagttatagaagtcaaaagtctttttacaatgtcttatagcaaaatcttctatagggtgcaaagtttgctaacttagtttaccgaggtttgaccttgtaatttgattgtgagcaaagaaagtgcaaaactaaacttctcatttattaagatatgttaaattcgagtattatgattttcaaattcaaacttagtaacacattttaatgtgtgattgtcctttgtaaaatatgacatcgcacataaataatattatgaaataattctagagtaattttacttttatcaacatttatttaaagaaaatatagaaaatcacaaaaaaatcaatgagggtaggattttaaatatattttttgattaacagataaaataaataaattcgttgtggcattttctaattattaaaaaactcaataaactcattagactagaaacagttgatatgttaaaaaaaggtattcaacagttgtaaagaatgcgatgaatatttaataaatgattaaatgttgtaaaagaagtaacaaacttggagttttagtttatcaaattttgttaggtatctagctccattcaccacaaaagataaggattaaggattgaaaagaagaaaataagtgttaatgaaaaaatatgtaagaatcatttaaaatgaaatttttttgacacacttttcatctcataaaaccacaaagccggccctaaaacataaagttgtatgagaattatctttatcttgtaaatagtgaagcaatttttaattctttagacggtaaaattcaaaatatacaaaataagtgacaaaagacatctttttgtaggtatatatatgcctttagtcaagtgattaagttcatttgactccgcatttctcgtcggagtttgactctattacatcgcgtaattccgcgtactaggaattgattatggatctggccttgtcgatccaaatatgtaaaaaaaaaaagacatacttttcatagtgtttgtcgtaaaactaattaagtcaaactttttggagtaccgcaccaatcatgtgtcttacacactgggagaagacatgagaaccaataagtagtgtcggtcgcagcgttactataaatcatattttatggcgcttaaaaaaatattttacagtatatatcaaaataaatttgctaactaccccaaaaataaatttggctagaagctagtatcccaaatatttttttgacagttaatataaaaaaattagaaattctaattaaatcataggagtgaatgatgtgcgttttatgtttcacttaaaaaagtgatgaacaatatcaacattaaaattatctcaatacttatatgaaactttttgtatttttttaatgtttcttagataataatttataaactgtaggtattttagattgacttatttgatctatatacttttgtaatatatagcaaaaatatttgcttttatcaaaaaagaaaaggaaaaaatgcaaatgatatgaactggatattctatgagtagttaatccatggatataatcttttaatttaaaccgtaattatcatgttgattatgagaactaaacaaaacattctcaacacatgcacacacatatatatttttagtaaatactaaatatcattttgattaacagatctaagcttgtctttcataacttttttcaattaaaataaaactcatgcaacctccggttccttttcaggcgctaatctaaccatgtcgattcatattaaaactgtaaggaatattgatcacgtcgaaaagaacatcgttttctttcttcatcggagatatttgtttattgtcgccgttgaatcccatttcgcaaatgcttggtgcttcttttgctttctgcaaatgaaccgaaactttaaacagatctctcactttaatgtacttcaaagctgaggttaacgcgtcatagccttcagaataaagcttaaggcacttttgcaacaacttcttactcagcctgcccttatattttctctcgttgaaaatcttctccacaattcttttcacgtttgttaggtttgataaagcgttattcgttcctaccaatgttaaatcattgctattccttgctttctgactttccgcattctcttcgagagatgcaatgcaaaacttatagaaatatcgttccgcgtactttgaactttgattgcaatatttctgaaccagagagttttccactctgttggccgtcaaaccattgaaaagaagaacaaacacaacgaggtaaatcaagaacttcattgtttctttttttctttggaagcaaaacattagaggtaatagattgaatagttatagtaacatgtgatcctatttataagcaacacagaagtcttctaacatgagagtgttattcaaacaaatgctttttttagatgactcatgtcatgcattaccactccgcttacttcgttgccttcttttgtggtcaatcttcattgcctaaaaagaatcattactctagacatttcgatgatatctctaatttcgtttgattcatagcaaaaatattttttttaaacttgcatagcaaaagaagtgaggtaagaaaaaaaatgtttatgccccttcccctgaattttggaatcttcggacaacaaaacttctagattataaagaaacaaaaaaatgtcaagcactcaaatctttcattagatcatcaaccatattatattatttaaaacttatgtttgaataccagaaagtactaatattttaaaggtgaaagtaaaatgtttcagacgaaagtaaatattaaaatacaagccttgtaataattatccgaaaatagcataaaatctcaacggacacaattgctctctagctaaccaaacaataagaagatagtggtttgggttttggtttttttcgtttttgctaatgtagtaaaggattttctacttggccttttccaacaagagctcctcaatgagtgcagctgcttgctcaactgtggcgatagactgtgctttctcctccgccatttcaatcccaaactcttcctctaatcccataactatctccacctggaaccccgacacacgaagcatgagtacgtccataacaatataacaagaatcatgagtatgtgtatctcagtaacatgtttagagatgtgtgtataaggagaagcagcgatccttcacaagacttgcaatctaaacattcgacaatatgagcttgaaagcaggatacaagtttaaagaggcattgattatgcatcaataagtccaatgaacaatcccatttcaaaagttgaatccaattattagacatgagaaagtagttaccgtatcaagggaatcagcaccaagtgcagcaaatttggtggcagcggtaatttcgtcagcctctttgagtgagagttgctttctgacaactgcacacaccttgtccactgtctcaggttttgcctgtttatcaacaatcaacaatggtgaatgatgaattggctcgagagatcaaaagtaaaatagaaacaacatcatatgagagaagagacaaggtcttacagcgcagtaaacagtcaagcgggtaggaagctggcgaagattaaaagaaagattgcttctgcttccatagctaaagcttttaacttgtttagccccaatcacctgccatcatattcgaatataactttccatcagtacaaaactaaactccaaatgcaaagcaatatatttgcactgaaacaaaccaaaagaaggaaacaaaagcaactaaaatctatgtaacccgcatgctcttaccaagagttcgaatctattcaaattcagatataaaacaaatccaattcgaagaggaataggataatttttccggtgattcgaccgagttaagtaaaataggttcaacagagcctaaaattccagaaaacgaaaactaacttacctcaatgcaaaaaaattacaggacaaaaaatgaattacagagcaatttcaacagatcaatatagagatgagaaaacgattctgcgaattagatctacagttgaagaagaagaagaacaactaggtcgagatgaatcagatcagatctatagcaaaatgggagaaatcacgacaaaaattcagtaagaaaaagatgagagattcgagggaagaagagaaaagagagaccagttgacgaggacgagcttggagagaagtagaagcagaagtagcaatggaagccatagaagaatgaatcgtagagagatcggagtgagatcggaggaggcggagaagacaaagagatgtgagacacagtgaagaatccaagtgggagacttatttttaattttatagtattttaacctaaacaaaaaaaaaaaaaaaacttttctgagattccaatgagagaattcagacagacaagtcaggtgaggtgggtgatttggcagatgcaggtagagaaataacaaattcggaaaaaaaatccaaacatattgttttttttcttaaagcgaaataaaacaattagtcaattacgatagtttactggaattataataaacaaccttcttaactttttttttatgaaaaacacacgataaatcataaacgtaagaaaaattaacatgttatttctataccttaaaacaaattaatgcatctttcatattttttaccaaatttttacaactattttgtagggaattttctactaatttcctaccaaatatgaatagtaaaaatttgatagtaaatttcttttaccaattttttttgtaatgataggattaatatgttccaaacaaatgctagatgttaagctaacggtgattcaccgctataaatgctaagcgaacggtgatccatcgcctattgcctaaaacatctaaccgagatatagaggatttttggcttaagcgtttaaatcaaaaaatttaaaatatctattagaatctgttatttctgttttcatgtgtctgattatgcacaatagtggaatgcttttttattgttcgatatatcatttatttatacgaaacaacacaaattaacttttttatatataggatcatatttatagtctttactcagtaattaattgttaaaatacataaacttatacagtttattttttcaaattgaatgaaataaccataagatatttgttgcatacttaattagaaccaatctataatctccttaatcttgacataactagaaacgattgtcatatatactcatacatctaaaccctttcaaagaaccaccaattggaacttcagtgaactcctctcgcctctcgttatacactataaccttgtcttctcttcttccattacctttcaccactaggaagagttcttcgtttcttgctatgcacgcaaaaccaacatcaaaatttccgtttctatctaagcacgctaaaccaacatttaaaatgttgaacgctttaacattttccttccacgggtcgatattccaatgcatgatctccttgccttttctatgcggacgccatagacaaatgtcattatttagacttgggtaatgatcgataacacatagctctcctcttaaaacccctaaccatgaactgtatttcgactccgtgtgcataggagataatagctcttggtactcttccttggcgaaatcgaaacagaggatggtgtttttcctacgggggtttttggtgtgagacctgtctgctatccacaaccgtaccggtccggtctatgaatttgcgatgaagagaagtatctggtacactttctctccaacagctttctttgaaagcatagatataggttttgaaaccaattttcgttacaatcttgtaatcattagaaatccggtcataaccaaatcccaatagatttgtggtttggcccggtataaccattggtattctcttgaattcctccgaacctggtttccaaatcgctaggtcattgttttctttgagggtcagacacatcattccacgacaatgaagaatacagacaggttcggtttcggccggtaatgtaaagggcaagtctagcttcaacaacgtggtttcgttgaggtttagacggtataaaccatctttgtgtaatgaaatgagatgtgatgattgttgattcgacataggaaaattgatcaaaacagatatattttggtgaaaatcaagaaaaaaaaaggatattgattgcttattttatatagagcttatgactatgaacaacaattcattttatagattgcttatttattaatattgagagcgtgcttacatgtttaactaattgtttagttattagttattacttctaaattgtttatagatttggaaatctgtatatatcaaataaaatttattatactgccacataagcaaatacaatctttaaaatcagcctcatcattaaaagaacaattttttttgttgaacatatcatcattaaaataactatataattgatttcttacttttttcttcagtcaatataattatttacttgatttgcttcatttgtttgtttattgaaattatcaataatatcttagttttacctaaagtttggaaatagatttttgagtttaaaaaatatactttttatgatttttctcttatcaaatatctcaatttctttgatatagttttacaaatttgattcgtgaccagggatgggtgaatttgaaggtatggttcggatttgttcatctaaactttaaagattataattaacttactcttagctcaaaagtcacacgtttgtcaataacagagtgtgctcaaggacgtctatcatcaagcacattagttcaacattagcgtatcttgagaacaaaaattccaatatcttcaaaccaacatgaagttcatgaacattgtgaattgcttgaagaagagagatcatgaaactcaaagattgtttcgcaagaaaaatcttacactaaaaaaaacgaatttagttttgatctgcaatgatttgacgactagagtcttatgaatatggttttgaatatatgaacaagtgaggttacaattagagaacaaagaacgtgaacttagtatgagaggatcagtgtaaagataatccaaacactagactctgcaatcttcttcacagatagagcattgcgtttcaacttaattagagaagggcttttggaacttcccatgaacccaaactcggtacatgtccttaccctttctccggtttactgctttgacacaacaatattcaagctcaacctatacacgagaatcaaaatatcataagatttgttattcattcaatcacaacaaagaatagaaaaactgaaaaaagaaagtttacctcaatgaatccagcatcagtaaatagtttcctggcagtgtcgagacaaaagaaataggaaagggttccatcagaccgcacatattccctaaatcctacacgtttctctggctcaaaccgtagcatagtcatgtcatataatcctgtcaaggtgtttagcctattagtttctctttatttgtaaacatatgtgatacagctcttaatagtgaccttaccataatctctaaataagagcagaccaccaggtttcagcacagcaaagcattccttgatagctctcggcattctttctttaggcactgccgacaatgtaaatatctgacataacataaaaagttggaataacaaccgtttcgattagaaatgttcacatagcagagcatataacacatctgtaaaaagcctaatagctaagaatcagatcatagaagattagaaacataaatttcagtttcacatctatcttataaccacattataaaaaccatgagatcaactactctagttccactgcagaatatctgacattactgtttcctacagtgagcattgttattcctcttaactaaatgagcgatgttcacataccagagtgacaaaatccaccccaccgatgcaatgtttgctctcactccctcctattaatgaagatatacaagattagctaggacgtgtatgagagaacaatgtgtatggataaattgctacagagagaccaaaacctgagtggttaagcataaacttgtctcgacaacgatcacatgccacccaatctggaaactcagaagtcgaaaagtcacaacaaaaagaatgaaagttatcaaccgaagaaatagcgcgatcaatgttctctttagtcctaacaagagcgtcactgctacaatcacaagcatacacagtaatgttcttgcttccactacacaaaaacaaagataaaacacataaaggttaactccaaaaagctaaatcggaagaataatacggcgaagatcgaaagaattataccgtaaaatcggaagcacggtactgccattaccacaaccaatttccaaaagttttgagttctctccacaagaaactaattcaggaaattccttcaacagataccttctttcctacacgaaaaccagccagccaagacgaagaaatgtaggaccccgaaatccagatttaaaaacactcaatttctcattcaaaataacttcaatttttacatctaataaggctcattacgaaggaatccaaagactccatgatccggtcattccggtgatgaacttcaccggaaaaccggaaagttggccggagccacttgtttaaaatgttccaacaataacatcattcttacccaaatcctaagattaatcaatctctctacatctcaaaaaattcagaagcaaatttttactactaattcaaacttttcttcgattgtaaatgataagagctgattacaagatatggagtagtgatgtgtgtgtagtaccttgaagaattttccggaggagtgacgggagtgaaaatcttgccatggctgcgaatctggtaaatatttggagagattttggtggtggtggtggagatggtgggagagagaaggatcgttctcgacgatgttcttgagaaattcccattcgaaatctttggaatgatactctcctgcttcttctcttttctccattgtttgttcaatgcctgcaagtattttctcttttgagaagtacggaccgggaaaaaccatactaaaccgaatattttttagaaaaccagtatatacggtttgattgaacgatttattagggttttggcttttgggtgttcaattctgattcggtttcgtttgatatggtttttcaattttggtttttcatttttccggttcatgtatatatggtttggtttcttcggatcgattttagtcgtttgatatagattaaaatcttcattaattgcacatttatataatgttacttataatgaaaaaaattaaataaaacatgaattaagtaaaataaatgaaaatttaagttcgtattgtaccgcatcacaaaattaacatctccaaataacaaaaagagataccctaaggagtgaagtcaaattgtttaagcgctggatgttttcaagttgaattctaggtggtctaatatgatatacccaataaattcaaactatagaaatcaaaccatgcttattattgaaaataaaactaacacatatttattcaacatgtacacattagaaacacagctatacatatattaatcttcgtcatattgaagattagaaacacacacaaaaattaaaaaaacgcacagtgtgatattagaaaacggctaatatccatccacacaacataaaacggagaaactaaaaaacaacttgcactgtcgtatagttctgctcaaatagatattctgttaaggaataaagaaaccacgtgatgtttcatcaactcaggatgtgtaaaaatgtcagtgtctttgtacaaaaccttgacgaccctcgagaggtttaggaatcgcatgacgatagggaaagcaaaagagtgatctctcgtcatcagttcttgattaagactcttccatgaatccaatgccatgattttgatctcttcttcggctttttcccatgaaataccatattgcttcatgtaacaatcaatggatgttcctacgtgctttctcttatgttcaaactgcattagatagatctcagattttaaaattatctttacaccaacgtggtgacaaaaattgtatttgtatgtagagtgtcaactacagcttaagttcttaggtctgatattataattcgaattctacaagaaattggatctcaatctctcttggaatgtccaacgtcaaatatcatgttctttttctaatgtagtaatgtgtgtcattttcttttgtaacatgttgctttctcatagtacatgttatatactacgatcacatgctattccttccgaaagcatggagacaaaattttacacatgacattgtttttttctttcagtatgacatgtttttttttaaatgacattgatttctttctcattctttcggatatctctctttcactgacaaaactcctgtcttaatttttttctcctttcagattttgtgttattattatttgtttcatgtttttccccaaactacatatgctactgaatttttgtcttttgtttgtggaaatctataaattttctcctatctttcctaaattttctgattcatggctactctggtcaaaatctagttaataatataatcttttagaagcaatatctttgtcatttaggatccgataggtcaaactagactggttattaacttattggcatcactacaataatgtgagttaattacctcgcaactagcaatgtcaccacagagacggcctattagtgcagaagtcacaagaaggggtgggaaagtgcttaaccattcaaacacatcaagggtgccttcatccaccatccctagaaaggatcctgttaacagagctaagtagctcgatgaataaactccgttctctttgtactcgtcaaatgttgccacaaagtcttcactcaaccattttgcctcttgaagataggctttagcagttacaatcatctgatttattaacatataaccaacaaatttttcatttagattcaacacacatgaacatagacttagtacttaattactaattagttttgtgcttttgaagtagttgtgtatataagtatttagtaataccgattttttagcgaaaaggccgcatcctgaccttccttccctctccatatcctcctcaagttttccgtagaaatctaacaccacatgatgaagatacctcatgctctccgggagcccttctatgccgctaggattccacataatcaatgaaatggttcgagttcctcaatcgtgccaaatgcatcgtacgtatcatcaacaagagtcaataagataacaacaatggccaatctaatccttgcttgagaatatcggggctcaaagtatgctccaacagcccacaagtagctttcgacagtcctattccttgcatatggtactttcaagtcgagctctagatttgagtaccacctacaaaaaaagaagaatcgacaatcattatggtagtctctccatatataagagttttaaaatgtatatataatctatcttgctagctcataatggcacctgaagacttggcaaagctctttgcggtgcaaaatttgcagaagattgaaatctatcttagcaaattctagcaaggtttggtcgtgcagatcttcttcttcatagtatgagatatattgtcgtgtctctatccttgatatacccctagggtatgcatgtttgagggcatttttaatgcggatggacataggtggactagattgatcagccagtccttccaaatgagacctagagaaagcaagagcttcatcgagaatgtcttcaccatgggtgctccaatgtgcagcttcataaaggcataaaagacctcttgcatcctcagctaggtgctccttgaactttccatccttattcttgaagttgttaaacacatcttacacatataattttttgttagtaatcaagtttaataattaacattgacttggtagatttactaatcattatgcacagagagtacaaagtgagtataccttgcgcttccacagtattaatatgatcgaattaggtgaagttgaaaaagaagaaaaaatacgctcgctatacttatgtcagttttcacattaaccaaaatgtaatatagttcttagaccaaaaacaaaatactactaacaattagcaacattctctttcatgactttttcttagtaatatcaattcaaattttttttaacccaaaaaatatggaaacataaataagaaacttattcatactgataaattaattaacatattacgctcgataattctaacattagagtgacttaccgacaccaagtttatagccaaattgtctaaaaatttggaagacgagggagacggtgtataaatcgaactcattgcctcttatcatctgcataaaaccatgacaccaaacatcgtctctaactgcgtgaagatgtctacttcaaagtggtaggaaacaccaaggcgacaaagagcatcaatgaatttgatgttctctatcggctcttcttttgaagccattaacaatcctcttacggtttcctttagtgaactcagcttctcttcgtttatctcactctcctatatacatcaaaataatggcacgagagaagacatcataatatagagtatattcatagtgttttgtgaacaaatttgcctaattgtgacttcaagtcgtgtgggtacgtaccggatccaaaacagaaaaagagatcaagggatcttcccatatattcaccggaaaatccgctaatggccgatatatttcttcagtcgtaagcgctgacaaagtatttatcagctcctgcatgcttaagttctttttctgaataaaagtgtatctataatcacacttcaaggttttctaaagctttggtaaaactgtggctgcacttgatacatatagaggccatatatagggagatgagcctccctctcttcttttggtgtttctttttttagtaacctttatcttaattttgtttatttctatggtattttcttttaggcgtgtaaaaatgagtcattgattgggactcttagccgacacgatagatatgaacacattggccattttacttttctagtactccctctgttttaatatatttctagtttaaaggtgtttttttttgttacaaaataaatgttgcttttatatttttttatgcaaaaattaaatatatttaatagttttaactaattatatttaatagtatattttcgaattaattttatttgataatattttataaaaaatagatatattaaagaaggtttttatgttttttcttttaatttgtatgaaaaatctttaaactataaatcaaataaaattgagggaataatagacaagtgacagattttcttcggttactaaaagagcaaaatcaattcattttaatattttgacgaaaacaaaacaaaaaaaaaaatcattttaatattttatgtccatcagcccgttgaattaggcttaaatggcggcgacacattaaagcttctttaattgcgccactaatatgatatgcgccactaatatgatatcccctacctcatatcaatcattgtaagtgtcattatagtttcttacatatattaacataacaattaaaaagaaagggttgccttccatgccaagccagcacatggaccgaattgttactcgctacagtgaggtgactggtgagatgggaacaagttgccatgatgtatgcaggtaagtgagggatgaacgcctgtctgtgttgctgcatgcctgcatgtgctatttgtttgtttccaaggtggtgtgatctgcccccgaggaatgtctaggagaagggttttctgctgtgattgctgaaggcaaataataatcaagagtcgaggaacaaaatttgtttcaaataaagtggaaagaaattcatatttgaaactccttcgttttttaaacagttcaacatttgatgtagattttaaaaatgtaaattctatttaataggctgttcttttttttatataatatgtgaaatctataaaaattaaataactatttgaaaaaagcttttaaattgattataattttgtagtgggttaaaatctagaatgtcaataaaaatataataaaaaaaccgaattaaaaatcactaataaaagccttcgaattcataatcccaatgcttttttaatctttttcttctacacaatttccagaagatgattactaattagaacgaaatataaaatacaaaatttgtccaaaaacttggagatgcgggggatcgaaccccgtgcctctcgcatgcaaagcgagcgctctaccatttgagctacatccccagttgttgagttacaatgcttcacgttttataaattcgaatatctaaaccaacatgaactcttcttatctccaagcgagccgcgtcatggtgctcggatctaaatctccggtagaccgccgccggaaatcacttgaaagagtggataaagaactcttaagaggcaattacgaaactgctctctcactcgtcaaacaactcaagagcaaacatggctgcttatctgcttttggctctgctaaattggtttctctcgcatctctctcttaatgcttatttgccaataaatcatctctaattcctttttttttttaattagcttccgaagaaattagacatgagtagcaaaactgatctcaggtcgttgattgattctgtctccagaagtattgaatctgtttatgtccaagaggtactttcaatttttgcagtgttttaccaataaacacatgtaatttcatgtaccttaattttttttattttttttgtaggattcagtgagaacatccaaagagatggaaattaaaacttcacctgaagaagattggttctctgttgttcaggtgaagatctcttagttgtcaaataaaactagaacttaacattgttgcaaagtgaaattttatcacaaatgttgtttggtaatgagaccaaatcaaatagaactttttgtggtgtacctttatgggcaaatatatataaattgattttctgcgacgtctgcagcatgaatcagggcattttcttgttggttacttgcttggagttctcccaagacactatgaaataccaactttggaagctgttaggcagaatgtgtcgaatgtgaccgggagagtagaatttgtggggtttgaattcctcaaacaagtaagtagtttgctcaacaaatggtcagctttgtgtatgttcccaaccacaagagttttatgttatcaccgcaggtcggtgctgcaaaccagcttatgaaagatgatgtcgacggccaaatgaaccaaggcaatatctcatccaaggtaagatttcctcaaatggacctgtaatgagtgtttttctttagctcaagctgtttctgtaatgattggtcaaatctgtgaatgcagacactgaacaacttttcatgtgtgatacttggaggaatggtaacagaacatatactattcggatactcagaagggctatactcagatattgtcaaggtaatacaaactcaagtctccttccactcatagtcatgagactataatcttctaatgtattttttgagatttgagtgttgcagttgaacgatgttctgcggtggctcggcttcacagaatcagaaaaggaggctcatatcaaatgggctgtttccaacactgtctcattattacattctcacaaagaagcaagagtctcacttgcagaaaccatggctaaagccaaacctattagcacttgtattgaagccattgaatccgctatttcaacacatcaaatttaactatttcacttcttcaaaccgaattcattactggatttgcaaacacagtttttgagtaacatgaaaataccaaaactattgtggaacagagagccatgtctatgttacaagctaaaaaataaaattaaaactcttgagaagcagatccgatatcgcctttgttctttccaacctttgatgggagaagagtctgatgaatgttgggcaaaactcctccattagcaattgttacacttccaagaagtttactaagctcttcatcgttcctcactgcaagctgaatgtgccgtggtacgatacgtgtcttcttgttatctcttgctgcatttccagctagctccaatacctaatgattatatcaacatcatataagagatcagactctagaagacaccttaacatcaaatcaaaatcaaagattcggtaaacatcgaaaaatctagtgatatatcaattacgagtgattctcatcatagagactaaaagactaaataccaaacagaagattgtttgttacctcagcggcgaggtattcgagaacggcggagagataaacgggagcaccggcaccaacacgttcggcgtatttaccggctttaaggaatctagcgattcttccaacgggaaattgaagaccagctttagaagatcgagagacggactttgtagcttttggctttcctctgccacctttagttgttccactgccggcgccggaactcattttttgtttatcgggaaatttgaagaggcgattgtaaaatgtgattagagatggctgaggattttgtgagtggagtgatttagggtttaggttgtgatttctgaaatatatagcgttgagataatggattttgattggttagttgtgagtcacgcggattgccagcgtggcaccattgtaagttctcgcgggtttttttttccgcctctttttaacaagtcggtgaattttttaagacgattactatttgtgttaaaattcggtttagaaaaaatgcaccaaaactataattcggttcggtttgaaaaaaaattaacatccaatgttgaaccgaaattagctcaatttgttgggtcatgagataaatttcaatcaaatggtagtgaaggataagcccaataacaaataacacaaacagctttaacatgggccaactaaaaagtgactgtcaagcataatggtggtgatgatgatagattgatagtggtgtagtatgacagattgatagttattaaattaattaagataattatatgtatatattctttgtacatttctgcatgtttttataaagtcaaacttaaaaagtcaaaacacttatgtcaaaaaaaaaaaagagtgaacaactaaaactcaaactttgaccacatgttacaactaatgaatttattgacaaataattatagcatacatggaatggttgcgacttatgcaaggtcgatatgttttgtatacaagggtgtttatcttcatcaaaataataacagtacaaagaaaattattctattcttagctagtattgatgaaggagacaagatagggttttgtttactctctacagtcgatgaagaatgcgatgatgcgaaagtatcttaagatgaagaagatcatgaccggtgttgtagtgactgaggtcaatcagcatgcacttggtaaccagtttgtgaagaagaatgacgtcattctcgagattgatggtatgaccgtagaagatgatggcaaagttttctatgaaaacaggttgtggatgcacttaaatggtttcattgctttgaacatgtgaatattcggtcccttaatcctttgatagcctctacaaaattttgatctttatagtcaaggtaaaccaacaacgttgattgtgaaattcaagtggtaaaaccgttaaaaacaacatcgagaccttgatttagattataaccattcatgggaaacattttgggtttaagtgacatgaaaaaagattgctttagactatgtgttactttgttatgatttttggaagttttaaatatccactaaaatctattaaatgagaacttatttcacaattaaatgataatatttaatattaaggtctgattagagaatgtgaaagagttgagttgacgcgattaagaaaattcggtgttgtattcttaaccctgcagagaaacatgagattataacactgcaatgcaacaaaatatacaatgcctttactcaattagtaaaaacccaaacgaaataaatctttatttctattttttgcctgcttttttcctttttttctcttttttttttgatgaatgaatagagagagttacacgaaaaaaaaagattacaaagaaacagtccatggaaatcgagagactgttgataatgaacattacatttacaagcatttacagaaacagatgataaaagaaattgattttaaatgttattttttcagggtattaaagatcatcagtgagtaaaagttgcagcaaacgggattagtatgtgaccccttctccattagagctttctttggccatagtttaactaaactcaacctgtaacacatccaaaaatgttgatgatatattgagataataccgttagaagaggattcaaatcatcgaaaaaaattacaggctatgggatgtattcttcttaccttcttcggagaaagcgaaaacaccaccaagcatgtcatcgtcctcatcatcatcgagttttccatcagatggagcatccttatgctcagtttctgtaacagtttcattggagaccacctcctcgaaaaactgctcgaagtttggggagccgtcaatgggtccttcaccctcgtctgctgcattcatgctcatatcagaacggttagaacttacatttgaatctccacttatcccactgctgttttcaatttttgtttcagcgggcagggaggcgttctttggcaagacatgagcgtcgtcgtctatataatcagtgtctttcacagcagaagaaatggaaactacaggctgtttaaatgttacaattccggtatgaggattttggtttggagttagtgcaaaatgggcactccctcttctttcctcatcttcggggtaaaccatacctgctaaaacttcagttttaagatttgacatatcttataatgcatggattaagaaagtaaatttgattaccattgaatggatgcatttctttaacttgtccagggtcagaagaagaagaagaatctgaatctctttccccagaaaatcctctacaagcaaagaagaaccacttcaaaattggatcaatgacagacgcagtttataagatgtgatgcagttagcgaggtaacttacctgttgcgcatactggtatacacactgtgaaaattatcatataccggcagaagatcctttcgcctaatgtcaacctcgttcgcagatactttcccgatttctgtctccccaccaccttgatgcgaattcaggttcttgccatcagagtctggtggatacatcggatagaaagatatctggaattgataaaatttaagggagtgtcagccattgtacattctatatagtaagaagacatgaccagcagagacgtagatggcacctctgaattttgccagattggttttcttccggagtttatcagcacctctgcattggcaagataaacatggtgtttctccagaggctttgtttgatcttcactatcagaagtatcaacagttaactcagcattttttcgtccaccataagtaagcccgcatatgttctcctccctctctggccaatccgctcttcgacagacatcccaacactgaactggttcaactttcactctcagttcctcttcagaggtcagcccagaagttgctccatttcgcgtattgctctcagcctggtctcctccaagagatggaatgagtttgtattgaactacatgacctgatggagtgtaaaccagtaagtagtccaaggcaggagatgacgactgcgattcttgtggcacagattgatggaaaacagcagcaagacagccagaggggaaggtgggttttcctacaacggaacttgcagcatggaagaaattgttgcatttgattcggctaaccacagaaagagtaactgacgctggtggtggatatgaaaaatgggtggtcataaacgacggacttgaccaccatggcagggataatgttggagcaagcgtcggtccatcgaattgagagtttcgtatttcaagaacattttctcccccgaacggggataaaacataaatatggcaggtgctcttagatgaaacaattgcaatccactgactgtagctactaaagcaaatatcttgtatcacctgtgggaatatagcacaacagcgtttacagtaacataaccatccaaatgaactatagctacaagagaaaaaggaataagaaacatacagctgatgtcatgccacgatgtagtttgtaaagaggcacatgggaagagctccaatcatagctttgagcacccggtccattctttgtaggtgtcggcataatccggaaaacgttaatattgttaccgtggattgaggctgttactagtaaagtgccactagggtcgaaacagagagcagagattggactagtgtgagccctgaattgtgctataatagctcgggactcaaaatctttgacaattacctgccacaggtcatattgataagcatgttatactccttgtgttaagatatccaaagtgcagaacaaaataaagacaaaacgttataaaacatttactatcctaatctaggttctcaatactccataaatggtttggcatatgtttaacattccacaacgcataccattctcaagcaaccgaacaaaaaaacgagggtttaatataatcaagataagatgctttctctaaaagactaaccgttccaacaacatctgactcagctgaatgagaaccgacccgaccaactttccggccagggctggacgaaagagaaggaccaggaccgtcatgcttgagatcttgacagtatttagatatagttttgtaacccttgtcacccaaattgagtaacccagctgccaaatgcttactagattccatagcgtatcttgccaccagattaccattatttggcgaggtagatggactgacaccaggaggagtaacattctgagggctcagacgacctatactagaagacaagggactattggaagcatacgctaaccatctagccccgacagccattggaccatatccaacattaaccccagatatcccttggtttccaagctgaggtacaggatacgagaggacactgaatttgttttcaagagttagcgcatcaaaacaatatatctgcatcacaatggaaaagcattaacagacagtagaaaacttgcactccatatcgaagagatagataagcacataaaaagctaacctgcgaaccgaggccaacagcgacaatccgaggactgcatctaaccatataaacagtagatctaaacctcaaaacatgaacatagttatgcgatctaagcgaataaaatcgcacaaccgtgggagagagtgcaagaggatcctcataaccatttctaacagatccatctctactagtaacaataggacctgaacctttagcttcatcagcaacagctaaaagtataggatgtgatgatctaaacccttcaactccatcacatttagcaggtaatggctgcatctgtaaaaatgtaaccggatcatcccgcctcgacacgaattcggtaacatcatttgaatcatcgatatcaagaacttgaaacccgtttgtataacctagtaatagaacgttcttgaaagatgattcacttgtgtgcaatctatcaaatgaagaccacaacacctgcttcaccaaacacaaggatcacaacaagtcaaacctatctcgataaaaaagactcacactttttcctaatctgatcaaaatcacataaacccaattggaaaatgaatcaaaaacccccaaattccaaaatagagaatcacgaattggggaaaatcaaaattgaggtcaaaacctgatctttaagctcgtgagaatcagaagagagggaagcagcgacggaggcgctagctgagcgaacaccggaggaagcagttctgatgcaagtagagatgaattttaacgaattgggcaaaaagccattagtaccattattcttcgtttgattatgattatctccgttgttgttgatgttgaccttggagttactcttcatagtaattatgaattcttcgtggaagataccaccggagatacaccggagaagagacaacgatcggaaacagcataagccggcggcgatttcgaagaagaagaataagtaaagagattgtttaatttgagaaattttgaagctttgccattttttggtaattggggttaagcggtggtgtgttttttgaccttcttcacggaagaagaagaagaagcgaagaagatgatgatgatgatggagaagaaacggttctttgcttttttttggtttctgttttttttttttttttgggtttgctttttgttttgttctttgggcctttgtggctttaagttttagttagttttgttttgtctatttggtttttgagtaaaacttaaaagtcactgtcctaaaagaaagagttactgtagtgctttggcgtctacgggtgttttagattgctgtgtaagcaaacaattttttgtattttttatctcgtgcatgttcacattattacctttttttttgggaatgtttaaatattatcattcaaaaattacaccaaattgattaattgaatcaacaatagatctatttattgtttaagaaatgtagagatcgtgcaagcttaatgttccatataatataggtcctagggctagttgttacttatttggtgtataattgaaataggttttagtttgcacgtcacaactcaaagaaaatcaaggcatccctcaggcctaagccttccatgtttagacccatttgcaccaaagcagttaatgcccaacgactagtgatttgggtaatcaattgctttgtatgttgaatcatatctttcttttttaggttagatttttttttttcttagtcaacatgaataatcagattatataccctaaattttttagaaattgctacactataatttcattcaccctctttattctagctaatcagaagctatcccctaatttttaaaaaatatatttaattattattgaatttgctgttcaccatttaaaaaaatgtactccctctagtcaatgtgttctcaactatattacatgcattaataaagacttaaagagtgactaattcgaaatcttgtcagattattgaagtaagagttttattacgtcgttgttagtatacagattatataacaaacaataaaatgtggttcccgtgtaaagataattataagttataaccttatattagacgacaaaaaaaaaaatgttataaccttatattatttgagaagttacaaaaaaagattaaataaatatggacgaacaagagaaactatatctgtatatagtacttaagttataaccctataactcacacattctttcagtagcaatgagtttaatcaaaatgattccttagacttgtatttatccactcacacggtttagtaatatattaaatgaaaaaaagctctaaaaggaagttgctcctatatatcttattcttcttttatatggttttacaaattcataaaattcaccaaaatgacagtaccatgcatataccaaccaccctacgatcaaacagcaaggctaaaacataactgtaagtgttttcactattttgtttcatgttttcaccctcttggttacgaaggcaactatgccaaaacttattagtaaactttgattaactgacttttgttgagaccaaagaacagttccaaatcttgcgtctacccgtctccaattatttaaagaatattttgtcagagttgcacgtttttacgaacaccatttcattaatataactatatgttcttttaaaataaaggccaataatttcaccaaaaaacttaaaaataaaagccaactactgtttttttgtcctacactcctacttgatttgtttttcgtcctttgttaattacccacgatatcttcaagcctttttaaaaaaaaagtgtctaaaacttctcaagatcctatataaatgtatgaagagttttgaacttagtacttgtcacaaatataagtgacaatatcctcttaagtctcttactctatctctctctttaactgtatcttaaacaaaaagaaagagtatgatcatcagaagaaaaaagaaacaacaacaatggagagacaaaagagcatggaagccagtttactcaggaagagtctcagcataagagaaaggaaacacccaaatgaagatggttaccctgaatccagtttactcagaaagtgttcaagcattttatttaacaccttctaggcgtgaaatgaaagatctaaatcaacaggggtcaacttaactagcattgagctcttctctaagtgatgagactatgcaactatatatcatgaatcaaacattaaacaccctaatctagcctaacgatcacctatgaatgagactactcaattattatgacaattaaaatacaaaatgtaagaaaactaaagattatcaataaattctaaaacaattgaataaatgttagtgatgttagcccaaaagagtttagatctaagaggctactgaaagtaagagcaagacggctactttaggtaatgttttgagtgaactttgctttgtattatttcacttaatctttaggttacaacatggttcccttttatagctaaacaatgctagggtttcaatgattgtaaactgacagctgtctctgtcttatcaagcttcggaggtcaccaaacaaccaaatctgttctttgtgttgattggatccgtacagacgctcctcttctctgtcttcactctgatttgttttcttgcacaggtggtggtcttgtctgttgagaagaggaagaacacttgttgggcttcgttgttgtgttggttgtgttgtcattgggcctgtttggtgagtggcccaataaccattttcctttgttaagctgagcgacgtcgttttctttctttgactctttagctgaacttgagctctgcttcgatctcatttcagatcttggagctgttgatggcggagcagtggagctcttgctaatagctactacaactaaccataagtgaaaactatatatgaaaagcttaggattttagttcttatatgatagtatttatatgaaaatataagtgtatccggatcgaccgattcagattgggcaaacccttaaaggagaagtagataaatgattgatcgtctggtcgattaccattataaatctcatgaaatacgtatgtctttcctctttttcgttgaaggactaacttttttcaagagagatttacccgttcgattgctactggtcttagtttcttcttactcgaactcgttattctcttcttggttctttgcttgttcccatctatagagtgtgtgcttcagatagtttcatagacctattaaaagataatatatatttgcaatgcatatgctctaggatcttaaattcaaatcaaaactaaaaatacaaaaaaagaaaagaaaaaacaaaaaaaagaagacataaacctagttgtttaaaccactaaaatacaaacgcataaacttactacacatgaaaatgaaacgactacatacgactgactactttgcatatatatatttgtgaattactcttcactttttctctatatataataacaacttgaagacaaagacaaaataataaaataaccttatctcttctctatatattagttcttgagatctctccaacaactctactttgtctttactcaagtatttcactaagaaagatagaatcacaaaaaggaaagagaaaatgagaggagaaatcgatgaagctaatcttgctcctgaaacttcacttattaacaaagagaatcaagactcatcggcgacaataacaactactctcttgctcaccacttttgtagccgtgtctggttcctttgtctttggctcagctgtgagtttacaattactaatttttgcttttgttcagtaattgtgtgttgtgttttgtgtttgaatcttaatttctaatttcgttgaaaattttggcagataggatattcatcacctgttcagtcggatttaaccaaggagttgaatctctctgtggcagaggtaaactgttattttatttttttgtcttttaatttattatgccatatgtttttgtttgctagctagataggtaaaatatacttaagtacatttaacttatgtgtatagtattagttactgatctaatcaatgagtatggattgaggcagtagtttttttttttttttttaattgaggcaagtagttgtgaaagggttatgatactagaagaaaataatgagtggagaattaaaatttaaaggattatctcactatttttgtactaataatgagtggagaattgacggaaaaaaaaatgagtggagaattgaatttttgtactgtagacgtactggtcctactccaaatgcttgcatgttgagataaattagttgtgtccggctattaattatgatctctatttcggttagaattttttttctttttttttctccgtcttgatttaaggtttataggtgtggaaaaaatatcatttagtagaaaattaagaaataagcatacctttacgaaagatgacaaattatataaacatcatcgtaaaaatcaagatatatcacctataaatgtttttaaactacatgcagtactcgctcttcggttcgattctgacaattggagcaatgatcggcgcagctatgagtggacgaatcgccgatatgataggcagacgagctgtaaaatttgttcttctttctttccatgacaagcgaatatttacatttttgcgtcaaactggtaaataaatcatttatttgtgtgtgtgtgtgtgattagactatgggtttctcggagatgttttgcattctcggctggttagcaatctacctttctaaggttagcttagtatttttctatatatctctctgtatttctcatcaactatatttcttcaagaagtacttaaaatttaccatgtggtttttgtctattaaggttgcaatttggcttgacgttgggagattcttggttggttatggaatgggcgttttttcgtttgtggtaaaatctataaactctagctagtagcttgaataatgaaaaatattgtggtgattacaagaaaacaaattcgatgatcaattgtaagatgagtgacctaatgatctaaataaatatatctctacttttcttatatatctatttacaataaacattagccttctacaattgttaatttcttaaaacgaaagctatattggtcatattagatactagattatatgttgaaactatttgttgcccccaagagtatgatatttcatatgtactactagctggtattccggcttaaaattgcgcatgcgaggaacaacacaatgaaaagataacttcttcgatttatgtagctgaaagttgttgctagctatagtacagtagattttgtatcgttctttcatctagattgttttgttaatcgatgatcaggttcctgtatacatagctgaaatcactcctaagggtcttcgtggtgggtttacaactgttcatcaggtatgaatatgttatacaataactaaattagtttttatgaatatgttatacaagaactaaattagtttttaaaaattaaatcagaagttacaaaatatatactctaaaagtattattttcatctccatcgatctttaacagtgttaacattgcagttactgatatgtttgggtgtctcagtcacatatctcttgggctcttttataggctggcgaattttagctttgatcggtaatatccgtcaacatactttaaataagttactcatactaaaaaattgttaattaattttttttttatgctccaggaatgataccatgtgttgtacaaatgatgggattatttgtcatcccagagtctcctagatggttggtacgttatccgtcaacatactacaagtttaatagtttttatgtacctaatgccaaatctagtctatccaatcattacgctaagtaacccaaaactttcattgttatagaaaataattgttcgcaaaaattctcaggcaaaagttggcaaatgggaagaatttgagattgcattgcaacgattacgtggtgaatccgcagatatttcatatgagtctaatgagatcaaagtaaagtaacactaaattctatttcttgagctcactacattttttacaaatttccattaaagtgtaaaatctcctgtatttctatattttctaggattatacgcgaagacttacagatttatcagaaggtagtatagtagatctgttccagccacagtatgctaaatctctagttgtaagtgtttttaacttataaaattgttcaataagtagttattttcattattctatgatgaaatgccaagtgggttttaggtgggagttggtctgatggttttgcaacaatttggaggggttaatggaattgctttttacgctagctctattttcgaatctgctggtacatgcacctttaatattgattaatgtgcctaaaccccaaaaattaaaaaagaacttcactaaccaacttaattttttgttttgtaggggtttcttccaaaattggaatgattgcgatggtggtcgtacaggtaagtttttgggtattattattttattttccccaattttttgatggttaattaagtgaatgaatatatatttatatagggtaacaacacaactaatacaaatatatattacaaaaataatataattatactaaaggatttttagggaagaaaaacctgagaaagaaagagaatatataatgttagagtgtgaattgtttccattcgaaagagaaggaagagagcaggatagcgatcagtcgcgacgactaattcctggagattgttgatcgatgcgataggtcgctggatctgtcgctaaatttaacgactaccaaacgaccatcactggcgactactaaacgatcatgaccataaaattataaaatgaacacacgcttctccgatacaaaccaaatcgttctaatctgagtttcatttgtttacctatcaaatacaaaaattaatctgacccaaaatttatcctataacaagattatagagagataaacccgtagaggaaccatatatcaaggtaacatgttagaaatacctaacattaaagaaatgagacgttgagtgatatatgaataatatggtctaatccacttttgttttgaattgaaaagccaaaataattacaattaatatataattgtttaacatttaaaattcaatgtatcatttcttaaaattatttgtagctgagacgaattttctttccagatccctatgacaactttaggtgtactgttgatggataaatcaggaagacgaccattacttctagtaagaaaaaacaagtgactaacatttttttataatgttattagtcaaatacaaagtaatttttacaagtaccttttctcactatattaaaaataaagtttttaaagaatttatgttataactgtagttccaacttattattgtttttttatcttttattattattattatacattggtggataattatatattgcctccctagtccctatatatatgtcaatatgtatatgttgaaagaattacatataatgaatttaatattttatctcttcagatttctgctactggaacatgtatcgggtgtttcctcgtcggtttatcattttcattacaggttctctccttatttatattttaaaataatatcttgattttatctatttttaacatattatgttttagtatattaatatcagtataaaaattgaatattttttgtctacagtggtgccatatgactttattgttaccataattataattttttcttctaatagagatttaatatattttctcgatctatgtctagatctagatgataaatatctagaaatattaatttttattgtttgattgtatattaatattaaaacttctcaagtagttgcatatatgcttcaaaatgtttataatttcatattatgtactataatttttgggttcatcctgttgtagtttgtaaagcaattgagtggagatgcttcatatctagcacttacaggcgttttggtaagtttgacgactaaaatctagatttcctttttttttatcctcaatttgaaaagtttgaaaatagttgatatgaatatgatagttttggcatactgaaacgttgctgtttgaaagtgggaatgactgtaccaataagatggtgcatgaaaaaaatagaagaactgatatacacatctatatcatcaaaatacgtttatttttcctgtaactcgttctgaaagaactatatagtagacgtgtttgagttgaaggaattttacgatgaatgacttgctaaaacaaatttccgaatactatgtcggtgaggaaaaactactagaaaagaacaaataatatcattattgttattaacaagtatttcgtggcttctgggatagcgaaccaactattggatgaaattagaacccacacacatactttgaaagatcgtagacgtccataaatgataaatttatcttattttttcaggtgtacaccggatcattttcattagggatgggtgggattccttgggtcattatgtcagaggtaagtaacattcataaaaattctttggttttaaacatactcttatacttaataatccgatcgatgtcttaagaaatattaaactttatatcataaacctacggtttagtattaaaattaaataataaattatttaactctcatatggttgtatgtggtatgattttgatcagtgtatataaattatgttcctttatgatttatttattgattctttgtttatataacattttaattcaatttagttggtgcgtagatattaattttatgttttatatgataaagatatttccaatagacataaaaggatcagccggaagcctcgtgactgttgttagctgggtcggatcatggattatatcttttacatttaactttctaatgaattggaatccggcaggtataaaatttgtttaaattttgcttttatcaataaattttgttctttatctaatagtggcacaagttttaaattttcaggaacgttttatgttttcgctactgtttgtggggctactgttatttttgtagcaaaactcgtaccagaaaccaaaggtcgcacacttgaggaaatccaatattcgattggttatgtagaattgtaatgtatagtagttgattacgagaatatcagtccctaattataacgattaaaagtaagattttttatttttcttctttccttttggtataatcgtatcatcctttttgcttagtgaatttgaataaatggtgttgtttttggttaccaaatatcggagaacataattgaaggtgtcgaggaaaaaaatcgaggttatgacgagtttacaacttctaaagacagtgaaagatattcgaagtttttttggacatatatgttgggttctacaaaaaaattataaaatatttctttgagatagttagaccgcttacaaaaatgttatgtatggaggtcaattttgatttcatggatgagtgcaaaaaatcaattttaaaaaatgattgtttgacaaatatccattcaaaatatactaactaagggattagatcacgatattaatgacatattcttgttttccattttttcctttaacacacacaaaccaaaaaaaaaattaaaaaaaaattttaaaaaaatagtcatttttcctctttttatatctaaaaacaagaaagaaaaccaattaaaaagaagtgacagagattgaagtgtgaagccatctgacgtgggacttatcttacgttctcttctaatctctacaggtcatctttctcggtggcacctttattcaccaagcaaaacaccgcttctttcgatcatctatctctttcccattttcttttcttgacttttttttctctctcttcttgttctattataaacaaaaaatgtgtaataattattcatcaatcctcagaataatacaaataggggagtaggtatctatcttgtcaccctctctctctctctcttgttaccaagatgagcttctacaaaagaagctttcactctttccttggccaaaccaacaccaaagggatgccgtttgaatccggtcttggccatgatgagacacaatcacatggcttaatgttgtgcacagagtatctagggtttgagagttacgacatgaggatgtccgataacgaggtggagaacaagatgacttgtcatgcggaggtggagaccgaaagggttgaagcaaagaggaggaagacgaaggagaatgtggtggtgcaagcgcagaaaaaacagtttcctccgcctctctcgtcattaaacagccgtggacagcgatatttttatctccgtccggtgagaaaagacggtagattggaacttacgcaagttatggtcgatcgaccagagattttccacgtttctagagtagatggacggttgagattacattttgtcgatggtgtcgagaatcccattagagcttattctggtcctcaagaaattgtggccttagaagaggaacctaagggtctaggtaatgagaaagagggaggggagattagtagatctgatctggaatgtggtagagagattaatgaagacgacaatgatggtgcatgtaatcaaggaatggatttatctataatcagtgatgatagtggtgcaagaagttggagatgtaaaagtagtcatgatgtttcggtgaatagtaataatgatgttgcacatttccatgatgaccatgacacgagagaatggatgtacaacagtggttttaagatcgtggcaagtaggaaccatgatgagaacaatcatcatcattatcatcatcgtcatcgtcatcatattcatccataccatcatcataatagtaacaataacatgaatttatggacccggacgtacgtgaggaccaggtgaggttattaatcaatgttttttttttttacgtggcggcttgaaacaaaaaatatatcaactaaaaaagagtacagctatattttctctggaagttccgttgtatttttataaaatattcgaaaagtcaaaggttgggtgttgttataagtagtgtcaacaatatgatagcgtgtgagtgtaatattattgttcgtttaagatgcttatgtatatgacttccataattgaaacatcttattacaactttcaattttcatattattatgcctttttaacaaagtattattccaattttgattacaccgttttttatttatgtaatttgatcaaaataaaatcgacagataatctcttcaaaagtttagagtttagatgttccagttttaaaaataattatgatgaatccggaataggccacaattttttttttttaatacaagattttagagtaaaactcgtaatcctctcagacacgaaacgacaacatgtaatattagtttcgttccaaaaatatcgaactgacgatttttaagcttcggctaagagttttactagttcagcaatgatacttagtggaataggccacaattcatatgttataattcaatgtttcatcatttaatgttttagaatcgaacttagtttggtgttagttaaaatcttttcgaccctcgtaattaagaaataaggaaaacataggtgaaaagatagaaggcaatgtaacgcaaacgagtctgtctgatcggtccaattgttggtcattcgtccatatatagctgtctgttgaaaattggaacattaatgttgtcaaaattctaagattgcaggttgcatttatagactccatttccctccacaatcgacaggtcacaggcctttacgccacatataaccccaagatacaatgcatatttaaaagttcttgtgaactgaagaaaagtttcgacgggttgagatacgagacattgaattttggagaagaaaacaaaagctagggaaaaagtttgtggtccgcaaaacattgaaatgcaataagaaaactgagttaaaaattagagtaggagccgtgttgattccctaggaaagcttcaagtataggagattgcatgaaacgttttgataacggaaatgttaagcctaataaaaggaagtcacctccttatggggagtttattacggcctatacatcgcatgtagaaaacgagtttctcggttagaacttaaaatggatttggaagtagtggttggttttctgaagataagggttagtgaaacttatccgctgtctttcctgttacgcttgtgacatggctttatatcaaaggattagaatatcaaaatttcacatatttaccgggaggataatcgttttgcggatgaattagctaaccatgctttttctttaaatttagtttttcactttttagatactattccaagatgttctcttttgtcggatgatgcccgttgtttggcaattcgatggcatgttgttgcttgttaagtttttgtatgttgctatgaataaatttggggaggcattatctccccgtcccctaccaatttctttttttttcttctatcccatatatatatatatatatatataaatttcgaaaactctttgctttcattttcttaaaaaatcacgtaaacataattttagaaataattaaataacaacttataatatttttttttcttcccatatatataaactccgaaaacatatagtcgtatattatttcttaaaaaatactttcaattgactttttccttttgtattaaaatctattctcccacatatttggtagttatttaaaattgtagttcatacaatcacagtctttaccaattaatttaaaaatcatacagtcaaattccttacatcaaaaatccttataacctttaactatgcgaacaacaaagattaccaaacttccaaacattgatctacagattgactaatttttatgcaatttaaattactaccatttttccatctatataaacccaatcttgcacccacaaaaaaaaaaaaaaaaagagaaacacatacttaatctaaatttctcctttctttatagtcaattcatatttttgttttcttccaaaatgaatcccaagaaaaccaaaggaaagcaaatgattaacatcaaaaaaattgaaaaagatgaagacagattggtcacattatctaagcgtcgaaatggaatctacaataagcaatgagctttccattctctgtggtgctgaagttgcgtttctcggatactcttgctcaggaaaaccatacacattcggcagtccgtcttttcaagccgtggcagagcgatttctcaatcgtgaggcctcatcatcgttgcaacgatcggtcatgaatgctcaccaacaagcgaagattcaagagctttgcaaagtatacaatagaatggtggaggaggcaaagacggaagaagccaaagtaaagaaggcagctgcattagcggagacaatgcccgtagatgaggatgcgtggtggaaagtggatccaaaggaggtggaagatcacgaagaggcgaagaagataatggaaaagtgtgaagggctctatgagaaactgtgtaatgaagctgctgcaaggatccaaagaggagatgctgagaataataacaaatgatccattaatgattaagattttaattagtagatcattactaattaagtatttttgagtcttaagaattatgtttttttttttgtcttttcttttttatacattatgaattgttattgttttctacaacatccagcaatggattaatgaaactgaaatattttatacataaaagaagcccattacagccattaggcccaattcgtgatctatcatctactcaatctctaaccctaatatctccaatcttcatctccgtcgatctccattgatctctaacactaaaattctactactcttcactttctacagcttaggaagagttctcgacaagctgattcttcgagttctcgacaagtttcagtgtttttgtttccgggtcacagagaacaaaggcaatttacaataatggcagagactaaacaaccactgatcggtcttaaatgggaaccaaagcttccaggcttatccttagacttgaaaactggttcaaccagaagcaaaacagctgagagttctaagtcagagcttgttgatggtctttgtcttccacctaatgatccaaggaagattaacaagatgattagaaaacaactcaaagacactactggttctaactggtaactcttctttatctcctctactcggattagtttgatccggcttgtgattaaattgtatttcttcaaactgtggataggtttgatatgcctgctccaacaatgactcctgagttgaaaagagatcttcagttgcttaaggtaatagattcttttgcttttgttgttgttttaggttccatagtccttacattattctaattgtatctttattgtagttgagaactgtaatggatcctgctctacactacaagaaatctgtgtcacggtctaaactagctgaaaaatatttccaggcaagtttcagaactagatcaaagagaataaccgtctctttcggtttctgtcttaacacaaacttttgttgtaaaaaaaaaaacagattggtacagtaattgaaccagctgaagagttttatgggagattgacaaagaagaatagaaaagcaactcttgctgatgagttggtttcagatcctaaaactgctctctacaggttagttactaccattgtctattaagaaacaatgtataggaaatgcttaaattctgtaagtattattgatagatgtaagtaaaataagtgtgtggtttatctattctatcaagaatttgtatttttgagaatttgtattcatatagcacatgtgcaatctttgttaagtgaatgtttttgtgttgattatggttttacaggaagcgtaaagttagggagattgaggagaagagtagagctgttacgaataagaaatggaataaaaagggaaaccagtctaagaacacaaagccaagaaggaactgaattatttttgttaagagtatgatcatagttttgggacacattttttctatttttaatagaatatggtcatagtattggatacactttcttgcggtgatataggttgtaatgactcttgttgtttatggcctttgtttaaaggattttgtgttattggttacacctttgataactgtaataactcttgttgtttatggtgcttatgttatgtatatccaaaaccaaaccttgtctagagctactaggtgggaaacttgtttcagcaagactgaaattgagtcctagtttacaccttttgcagaattgcagggtccaaccacgagagcatcgagttttatactttcaggtagcactcatagtacctccctgtttgagtcatctggcactgaccatgccacacatatttatgtcagcacagcaaaactttggtattcagcaagatctaaattatgtgactttcttcttttgaatcatagttgtaatgaggaggctaagagtattgctgcagctgcttcgagcaggggaaagattgaggtcagttgtttgaatttttgttttcgctcggcgttgttctatgatattatatcagctctttggaattaagaagatgaattgtgtgtgtaggatttaaatctatgtcaagttgaactgtttaagcttgctttttttttttttttgaatctgtgtattggctcggtgttgttagaatctaatttcttactaagtatctcgacaaagtcagtttcttggagagtgctgattacaggcagtttgagaaagagagagacgctagtttgagaagacacgatgagaccgactcctctaacgttcttctacatctgctgtaagtaatcttgttttctgttctgttagagaagtcttctttagtagactttgtagcattttctcaagtgatttggtcacattctttggcagtgtctaaaccgagtccccgttttcttgattgattcggatttatttcttatgtctctctcgagagagagttcaaaactgagaccatcctctctgaaggccatggccaatgaaatgggcttgcaatgcaacgtaagcccaacttgaatcccacgattctaattcgagccgatatctgaaacaacaattcatttgtgactgcaatctacaccaatctacaccttgttcttgtaaatcgtttgttttcttagtttctacctaatgaagctcatttggtctctatacaacataaatttcttcttttggttttgaaatctaaaacctgaagtaaagcttgattgatttggtttatggattgcaggggaaaaagtggctctctctttaacatttacaaaaaaaaaaaaaagtggctctctacagagttgatagtcgtaaacaagcaagctcgtgttaggttttttctattgttggatggttttgtatcaatgttctcaatattgttttactagataatgaagataacttttatattgtaaatatattaaattcattttgtaattattattttttggacaaatataaatgcatatataagtaaaaatgtgataacacgtttcattgagtgtatatttaaaatgtaattatgcaaaaaaaaaattaaaaaatatttaattagcaatttagaagtttaaacatcaattctgttttgagaaaatagtatagtttatagacatgtagtatagctaatgtttatttcacacatatgccaatttttagtaaataaatcgtgaagtgatcatcaccataaaatctgatggccgcaattcaaacccatgtaatcgaattttgtttctaagatagaatctaacacaaaataaattagtatacatacatgatatattaattttttttttgtaacatgatagattaattaatttaaagataagaaaccacacacataaattatttatagatttttaaaagtttcaatatttattacatagaaacccaaaaaatccatcataaaagcggttatcaggaggcgtgtaaaatttcacttgagcaaatttgttttggttgcagagatttttgcaagcaattctcacaaaaaggaagagttgccgttttagaatctttcatgcactgatttgggacacaatgtttaacacatacttctatcgtactcgcgtatgttgaaactatcatcgttaataaaactacaatcatcaaaacactatatatctttttcattgtttcagttgccattatttgaaaatatgagtttgtgaatgtttgaggtaataaaaatattgtttaggttatatagcaaaaaaaaattaacaagataattagtgttgagttggctttttgtagttttgtactttatatagcaaaagtatttttatccacttaaaattattgattttggaagtatatccgtttcttattaattaaaaagttagttttttttttgtttatgttattagctgtccaaacaatcttgcaatgttaaatcgtcatttaccaaaaaaattgccaaattttcaccattgtcaataataagtcaaatattttataatcttaattcaaaaactatcccctaaaacatgattatataaaaaaaaaatcgtattgatgggtcgagatatttagcattaacttataaaccaaaatgaatttacaggttgatttgatctatttaaatttattggattcataggttgacctaattaatttagctaaataatttatctaacactcaactaattaagacaatagatggtacccataatagattaaatttgagtaacttcaaaagtttctattcagttttttttcttacaatttttttgtggtattaattctaaagcattatcaataatattgtcacatttttaaaaatcttatttcagaaattatcccctaaaaaagattataaactagaaccttttttttgtattgatgggtagagatatgtaatcatttaacttacaaaccaaattgaatttacatgttgatttgatctatttaaatttgatggattcatgggttaacaacaacaagaaaaacaaaattagtttaatattataccacatgtcacgctctagtgagaatgttaagagtttatgtaataacactaacaaattttgtatatttttcctatactataaacatttttaatttttttttttgaatatattaacaacaacaaaattaatagaatgaggttaatagtttaatatattagcattttttatataagaagtaaattttatttatttttgaatatttaacaaaaacaaagtttaataaaattagtttaacagtttaaaatagcaataacaaaagtcgaacataaaaacaattttttttcttacttaatatatatatttcttttttcgataggattaagaacttttgtatttctatttttaaaaatattaacaaaattaagtttaacatcttaagttttaaaaatttggcaaatttttaaattacatatatttttattcttttgtttttgaaaatagggagtaatagttaatgtagttatagactatagagatgcattgtcaacaataaaacgccacgtcgcagcataattaaaatcttttgcacaaaaatgtggttggccttagccttggccctggaattaaaacattatccagaaaatcttacatttccaccaatccttcacttcctttcacgatccaaaacaaaacacaagaaaatgcaacaaaatcttctccatctctgaactcaaaaactcattcactgagaaaaatggagacccttctctcccctcgtgcgctctctcctcctctcaatcccaaacctttgtcccttcaccagaccaaacccacttcacattcattgtctctctcaaaacccaccaccttctccggtcctaaacacctctccacccggttcactaaaccggaatcaagaaactggttaatagatgcaaagcaaggactagctgctttagctttatctctaactctcactttctcacctgttggcactgctttagcctctgagttcaatatcctcaacgatggtccacctaaagaaacttacgtagtcgatgacgctggtgttcttagtcgagtgacgaagtcagatcttaagaagcttttgtctgatcttgaatacagaaagaaactgagactcaatttcatcactgtccgaaagctcaccgtgagttttttgttttcttatgaaattgattgtttttgtttaaccggaaattgatccggaaccggtttggtaaaatttggcagagtaaagcagatgcgtttgagtatgcagaccaggttttggaaaaatggtatccttctattgaagaaggtaacaataagggtattgttgttttgataacaagtcagaaggaaggagctattactggtggtcctgcttttattgaagctgttggtgaaaacattcttgatgctaccgtctccgaaaatcttcccggtatggttctattactctagtttagtatatatatagtgtacttttggaattttgatgcatcatctagtgcccaagacaaaaacaaaactagaggtttggttttgattaggatttttcggtttataaacaatagtaaccaaagtagaacctattctagtgtccatcgtttggaatggtttcggttttggtttggtttcggtctaattttcaagtagaattttgggactggctgtttctaatttctctttgtttttttttttttgtatatagagaaaatgaatccattaaattttaacattttcttttatatccaatctttattttgcatactaagttgaaaacatattttttaacaaatttagttttaacttttaagaaggagcatattgtaccaacataagttttcagctgtaatgttagaaatcaactatgttaagtttgagttggtattgattagtttttgaatgtatgatggtgcagtactagcaacggacgaaaaatacaacgaggcggtatatagcagtgcgaaaaggttggttgcagctatagacggtcaaccagatcccgggggtccaaccgtaaaggatagcaagagagaatcaaatttcaagacgaaagaagaaaccgatgagaagcgaggacagttcagtcttgtcgttggaggattacttgtaattgcctttgtagttcccatggcacaatactttgcttatgtctccaggaagtaagtaagtaaactcggttcactctcgtaaaccaaaccgatcaggtcagaactttgatttacctcggttatttggttatggtttcttggtaaattggtttatttgaacaatataagtaaataataacagaaaactaaagaatgaatgaaaccatccgattgtaacggcattgtttaaaatttcaaggttagaaaaaatggcatttgatctgaaaacggtggatcggaatattttccggttaagatttgagatgagacgaactcgtttgcggcttcggtataatgaattccatcccagtttatgtactcggaactatcgttgcaagctttggctgttactgatatcccatctaagactttagtttggccacatgtaatgcgactatcgtaatttaatggcgcccctccgactccacaacacgccattaacggtttttcgaagcctaaaacattcaaaattttgttataaccaacattctcaagatggttaagatcgataagtggtttagtgaaatgcttaccaaatcgggaataattagcgatgagattagatttaatagagaagatgtcaacgtaagtaacatttgcatcagggtattgagcttgaaatttgttggacatagcatggagttgaagattgaaaagcttagctgcttggttatgggaactaacgcaaccaaactcatcaagttttgttgaatctgtcccaaacttggcaatattttgagctaaacatcctaaaggccctgtgttgtgtatccaaatgtttctgcctccttcctcataaagcctctgccaaagtaaatttctcatttgcatgagaccactccgatttatccaaataaacgcccttggcgaaaacaaaagcgagaaatattgatataccttgaggccagcttcaaaagtttcaagaatggaaggaatagaggcaagaacttggtcaagagtcttggagtagaaggcaccagctatatcattttggcctatgtcaatcatgtataatccttttgaataataatcaattggtggtaagtacttttcatatttccttcctgaaaaatcatcaaacaaaccattgcttcatttctacatcatataacattatacgcaatcacatctcaccaacaattttttttaaaattagtcccacctgttttagaaagtaattcaatggccctagatttgaaccggatgaattgagagatttgaagatcaaaggagaaaggagagaccgaggtcgggtttgcgggaagaattgtggatcctgctgctgcaaagttacacccttttttgaaatttggtaaacctaatgaatccaaatatggatttaaaaatggcaggtccatttcatccactgcacaacacaaaacacatatcaaaaacaatttctttgaattgaaggaaccatttcaatgagaggaacaacatcagtttgtatatatacatagaaaatctacaataagacggccgtcacaatatcttcctgaaggaaggttgaagtaagtctggccatagggaggattaacattttcaatcccggcagatatgagattgcccgtgtcggaattcgagtctccaaagttgatgattgccggatattttaggattatggagaaagatgagggcaagaacaaggagattaagatgaagagaacaatggagagattgtttacaattggagccattgagttggaaacaaacaataaagccactatgagattgtttatctactcgctaaaatgagtatcaaactgaaaaaagcaaaatataaagtgtctacaacaaccatgacaaactttcattagtaattaatctaaaaactagtataaaacaagcaagcgaaaagaaaactgattacgtatcaaatggagaccactctcagattgtttttttggtcactaaaacaaactaaagaaaataatatttaatttataaatatatagtaaaaatactattagactactatttaatcaatataattagcttaataccacgtacctagctattaaatagatttactgtaattgtaattctacaattctaagaattcatttaatagaaacatacaaaaatatacaaacttagtaatcggattaataattattttctcaattacaatcacatatttgtaattgtttgcactattaaaaccgcattttgttatatttagaacatgaatttttaattgaacggagatatatcagactcagaaatgtatgaaataatgttgcttcgagaatgctccgaggttgcttcgtgaggaatatttatcgagattatttttttctttaaagggatgattagtttggttccgaacgaagaaaacccgttagtgtccttgcgctttcaattttaatgagagttatgattttttttatttttttttcatgttaatgttttggggattgcaatttctatgataaatatcatgtaattaacaaaaattaaatatcaattcatgtagcaacggacgaaaaatacaacgaggcggtatatagcagtgcgaaaaggttggttgcagctatagacggtcaaccagatcccgggggtccaaccgtaaaggattaagaattagatattatctttaactataaaaaatcgaattcaaaataatctaggattgatatgttctattctatctagccttctatttttggtcggctctatttagctttcaatatttagtaaactcaatatgtatctattgattatataaaagagtgtgtttcaatagattgtagatgaataaaatagttagtgaacattattagtgtaagaagataatagaaattgaacaaaaaaaaacttacttagaaaatctataacaagacgtccatcgcagaatctttgggatgaagttttgaaggaattttgtccgttaggaaggtctagacgaatgccaaggccagcaacaagatcaccggtatcagaattggaatctccgaaattaaaagcagacggataattgaaatcgatggagtttgaaatctgtaaagaactgataaaaaataggatcacatagaagagtttcatcttagttatattcatgaactctcgctatgttgtttaaatttgcttttgagatttataatttctgtttttcgatgtctttttaaatgtggtgatgctttaaattgtggaaagaggaaaacactatacaagcaagattgttgctttgaatctcgcttgcaagtcttactatctctgtgtatttttatatgatgactcacataaacacatttgatacttaaaatggtttttccacccttatattaacctttgatgatttgcccgagtgagattttctttcttgataaatgtacatatgcaacatcttgaaagcataggaaacgacaacgtctatcgtccgctaaggttatttgctctattattaaggctattaattatggactttaggaggggactgaaagaatatcgcttatgatttccatgtgattggggtgtggaacaggaagagaaataaaagaaaaagtggaaatttgaaagagaagtgaacattagggaaataaaaagaatcatggctcaaagtttataagtgtagaaagaaaaaaagtgtttatgtgtttatcaccgagaattctctcaatcttttttttgtgaatcagatttttctcaccttttttttttgtttttttcttttctttctgtctgatgaagagaaaagagttaaatatatagagtccaacggttccggcgtacatttgcaacattacatttaataaattaaccataatctcaatagttgcaatggttagagagtaaccgcttataacacttaaatctccaacatgttttgcttgcagtttgtggcactaattgttataagagttagctctctcagtagcaccaaactggtaagtgagtttctgatacaagtgttgttatataaaaatccaatgtgattgatcgttggggatgatttaacaaagagaatgatcagttctgagaagagcatttaaactttccgttaagtggagtgatgaagatgatttattggtgtaaagacaaatgttacgttgctatctattttggggaataatgtaactttttttaccgtgctatctttactatgtagacgtatataatttctgtcaaacatcttacttcgattttccataactctgttgttacactttcaagagatcatctataactctttcaagagatctaccaagttattcaaaggtaggaaatgcctacaatgtgaaacttaaaaatttaacatattccctcttatttagaggtctagttttgattttcatgtgaggagaacgatttagtgtataatggttttaacttactctgtgttagttaacacatatttatgagtaaattaaatatcaaatgttggaagttgctaagcatattggcctcatttactttgctagaaagttaatactctacatgttttcactataaacccttatcatcatgcatattgctgacaatgttattttagtttttatgaaattaaaataatatgtgaaatagtgaattctgtcaactaaaaattatttcagtcaaaaaataaaaattataaataaaaattaattcgaaaaacaaatatgagcatattattaatgtaatttttagcctaaatggcaaatttttccctacacaaattagctcattatttttcttaacattaaaattatttgtctaaaacctgcattcttctaatagagtgaaacggttttgggtttaagacatgtgagattgaacaaacaagacgttgacttgtgagtagaaggaacatgtgaacttatatggaccatgtgaccttcaactacaatcattggaatgttaaactactgtcttctcttatttggcatctaaattttgtttttattactctctaaacaaaaacgaattaacaagatttctgcacaaaaatgtatgcattttgttttacgtacaatcatctaattcgaaacatatggggtgaaattttttactttttaaagacaacaaaccaatcaatcacacgtgaatattgccagaagagatatacacttggagaggataatgaaccattaggtgtccccaagtactaaactagacctctacggtgccaaagaaaggttccggagttatgagtggtcacctctcctacctctttgaaagacatgtatatcgctttaactccttaattattgattcttgtgtgtaagggcaggcaacctatgcaaatagacaaattcatatttttcatcgtgatcatagtaaatactacaattttttttttttttttttttttggtaaaatattacaaatttagcaaaagacatgcaaagattaaagacgctatgataagaaagaaaactaatcggatatataactaaaaagacgttgaaaatggcaaatatcaatcatcaatccaaataatattcatatacctttcatctatgaactaaggttttttaactaatatatatatatatataccgtatgattacactgtcaaactaaagtataaaatgcaacaatagaaaatatgagaaataaaataaaatatattaattatttgcttttcaactactttaatatcttaatttaccatgagaaagaaatgaaaatatgagtcgaaataaaaaaagaaaagaataagtagtttgagaacaattttttaaaaaagggtaaaagactagaacatatagtcaattgatcatctacacatgttgttgttagaagaaaaaaaccaaaagaccaaaaatccaaaaaggaatttctcttcacattatgtgtatggccataaataaaaacttatctatctatctcgcgggaggaaaacaaactgctcgtgttggtgcttttgtaattcgtcttttcttatgtattatctttaagaaaagtcttttgcattgtgcacctacacaacattccgttttactaaaagttaatataccaaattgcaaataattcagctccagtttactcttgtttatttagtttgattttgggtgcatttgatatctttttcatcgaacttatgtaaattttctctaataatcgtaaactttttctaataatcgtaaatttattatcgtcaaatattccaatttgttattgaaatgttttcgtaatatacctcaatttcaaatttaaatattttattttaattttaaaattgcgtaaccgtaattttaattttaaacttgctcaccctaagatgggttttattttctcccgaatttaatatttaatttactaaaaatgatatgataagcctttatgtatgtaaactttttttcttaccattttttttaatacttccattgctctttttttctgacgtcttctttaatttattctactctatacatatctgccatatatgtgtatatagagagaaatatacttcaattcgtttccaaacctatactctcctctctcacaaaaatgaacaacaccaaaatggaaaacaaaagccatagcaaccaccaccggtaccatcatctatcatcccggagccacgagcaaaaccagcgtggcctaatttcgataaatgccataatcatcattggcatctccattatctccatattcataatccttgcaattctcctaataatcattttacttcatcgacttaaatccgcaagagtcaaagcacaagaattatcttgcaaagaaagcttcaacaacatgaacaatggtggagcttccaccaactacagctacacttctagccctggtaaaacacctaaacattcattccataattttgtaaagaatcataagtttttaattcaaaatcaatcagcaatgagtggagattctcatatctttatatcagtattgaattacttccacatccaatgtgtatttcttattcgaactttaatgttcttgttagatgacatcaagagagattgtctatactcaagaaacccaacatcgttcagacaattacccccacagacaaaaagttgtaggagaagccgagccgaaggagtagaagtgtacacatacaaggaattagagattgcaacaaataatttcagcgaggagaagaaaatcggaaatggagatgtgtacaaaggagtactaagtgatggaactgttgcggccattaaaaagcttcatatgtttaatgataatgctagtaaccaaaagcatgaagaacggtcctttaggcttgaggttagtcgtgcccacttcatttattgtccattttttcttatctactcttggtgtgcttatttattgtttccatgttatcaacacatgaatttaatatattagtcataaagaatatctaaattgaaattttgaataaaataccgttgcattgaaacttttgaaactttgaaatgtattatagttagttactccatgtaggtgactcacgagacaccggattagacatacctctcctctacaattataaatatgatcacttgtgatattttagtaaaacaatttctacaaagaaaaatccttcaaatgatattttcaagtttatgttcaatttgcaaaaatattgtatgtttaatccacaatataattagccgccactacattaagtttgttaaattatgataaatcatatattaaattaaaaaaattgtgacgaggagtacccatttgcttttaaaattttaaaactctaatgtctgtgactgtaatgttttaaaaaaaaaatacatatgagtattatattacagataaaattctgttttacagatttgattatttttgtaattttgatgtaaactttaattcggatataaatatatatatttaatagacaatggagtagtttgtgttttgaaaaacatatcttaaaagtgttagctcaaaatacatttatcctttcttgggattatacaatatatatgttgaccaatagaattgtttttgaagattcctctaattgacatgcccctttcagaatgtgctgggatttttttttctttggcattcatgtgctaaaatttataaaaatctaatcattgcacacatattttggtccgtgtttgtttctgtatatattttagtagagaaaaagaaagcaacctttgccaaaaaaaaaaaaaaaagtaccaacggcaacaaaaaaaaaaaagtaccaaactaagtggatttgtttattaattatttaattagtagtaactaaaaagtctatcatgaatacgctatcatgaatacatattagtattcatgaatacatactacatactagtataagtattcatgattgactttttcgttttttttcttctctttatttatcattaagaaacgaaaaagtcaattatgaatacactagtatttgtttctcataagtacagtaaatacatacaatcttttgcacatcattttgtgtgataccattaagtttgtccatacataagcgaatataatcttttaatgtgcaggttgatcttcttagtcgattacaatgcccatatttggtggaattacttggatattgtgcagatcaaaaccataggatcctgatatatgaatttatgcctaatggtactgtggaacatcatctccacgatcataattttaagaatctaaaggatcgacctcaaccattagattggggagctcggcttaggatcgcccttgattgcgccagagccctagagtttcttcatgagaatacaatctctactgttatccaccggaacttcaagtgtaccaacattttgttggatcaaaataatcgagctaaagtttcagatttcggattagccaaaaccggatccgataaactaaacggtgagatttcaacaagggttattggcaccacaggatatcttgctccagagtaagtaacacttcacataattgtttcatatttttgcaaaacaattttttttacaaaatattagcaaagtgtgttgatccattagtggttgttgactatcaatagtgtgtcacttttgaatttaaaagatggattatgatcagtcaattgctcttaacataaccatttaaaaacttattgggattgagataggtatgcctctactggaaagcttactacaaaatcagatgtttatagttatggtattgtgttactacaactcttaacgggtcgcacaccgatcgattcaagacgtccacggggacaagatgtccttgtctcttgggtaagtataccgtaatttattttcagtaacatattatcaatttgaactactcaataaacctccacgagaacatgtgcacttgtctacacttgtttagaagtacttatatagctagtaattaattgtcaaactgtggtataaattttcaggctcttccaagactaaccaatagagagaaaattagtgaaatggtggatccaaccatgaaaggtcaatactcacaaaaagatcttattcaggtctgacttcattacttctttctatctttcctttgcaatgtggagtgttgggttttcccttagtacattcctatatgacaaagaaagaagcgtttaatgtggttaacttggaaacatagtggatgtggcttcgcaaccaatagactatctacctttgttgtttgatccaccacaacatttatataaccattgaactactaatgtgtggatgacatacgctatcgagaggaaatttgtatatgggcaagagttgtgaatatattttatgaaacaggtagcagccatagcagcagtgtgtgtgcaaccagaagcaagttatagaccgttgatgacggatgttgttcactcgctcattccccttgttaaagctttcaacaaaagtactgattcttctcggtttcctagccgtagagaaagcttgtcatttgatgatattatgccatgacactcttttgtttaatatgtattaatttctctcttttaagttgagattctcgttgttattgtatatttgtataggtaaatgaatccatttatcttgtactataacttatattagtgttgtttaattgcctagaagtcactcattctaagtccaccaatattcgtataaaatattcacaagacttaatgtcttcatccttcaatatatcgagaagtccatgaatctcagactactaggccaattcgttgtgggcctcgtggcccagtaataataattattaaaaaagtataaagggagctaagctaaaatgatttttttaatagattcgaaaatagaaagtaagcattaccttttaaaaaccttctcctacgaaacgccatctgtcttctaactcctttttattaagtttcttaaagaaggttaaagaaaaaccctataaaataaatatcccaacgaaggcgataaaacccagattttccagatcttaaattctctcctcccccaattccatcttcgcaaattctccagattcttccgtcaatctttgaggtaatcaattttctcttaaatttcccaacattttttctgggtttatttcataatcaaagcttttgtcttcaatttatttgttatcgagggctaaaaaaactttgatttatgatcgtttctcttgttttgatgaaatgtatttttattttgttaatttcactacttttgcattcttttgtctgatttttatcttgtctgattattgttttgtctgatttttatcttgtctgattattgttaatgtgtttaagttgtgttttttttttgttttcaatatgaaacttataaattcattagtgtttttgatgatagaattaaaattaaaaactttgaaaaatgtttctcttagtttggtagagaaatggatcaacaaggacaatcatcagctatgaactatggttcaaacccatatcaaaccaacgccatgaccactacaccaaccggttcagaccatccagcttaccatcagatccaccagcaacaacaacaacagctcactcaacagcttcaatctttctgggagactcaattcaaagagattgagaaaaccactgatttcaagaaccatagccttccattggcaagaatcaagaaaatcatgaaagctgatgaagatgtgcgtatgatctcggccgaggcgcctgttgtgttcgccagggcctgcgagatgtttattctggagcttacgttaaggtcttggaaccatactgaggagaacaagagaaggacgttgcagaagaatgatatcgcggctgcggtgactagaactgatatttttgattttcttgtggatattgttcctcgggaggatcttcgtgatgaagtcttgggtggtgttggtgctgaagctgctacagctgcgggttatccgtatggatacttgcctcctggaacagctccaattgggaacccgggaatggttatgggtaacccgggcgcgtatccgccgaacccgtatatgggtcagccaatgtggcaacaaccaggacctgagcagcaggatcctgacaattagcttggcctaataaactgtgagttcttggtttagatttgtgctttatcgttacatggacacaaaacttgatttgattgttcttgtttgttttccgcagagccgtctaattcgaagctctccccggtggatctactcaagaagaagaatgttaatagaaaactattgcgacataaaaagtttggtgtagtagaataatttctgttttatgatccatggatttatctattgttattcagtttggtttatcttgtcatcaaactgttttcggtcaatgtaacaaattcataaactgagaattgaacttacaaaaggctagattactacttataaagttcaaagctacagtgatattgtaaactaaccagtccttacacatagttttcaaaatggcttagctcgagtttaaatagtccgtacttatccctacccataaccaaaaccaaaaaccgacgcttcctatatcactaccaaacgtttacacagtttgtttctgcaagtttttcattacgactccttcaagaattccatctgttccaaagttgccagaaaactcgtgtggatggacaggaccggggaggcggaacgagacagaaaagttaccgggagggcagagactccgcgtttgcatttcaaacacatgagaataccgtttaactcgcttcccgcctgttgtagtgactcctctaactagtaccttcccattgtcttctacttcacagctaaaatatcctgcaatatctcacactcatcaaatcaagaaactggtttagtgggatgagagatcttctagataaagcaaaaagtaactcactttcatctcttttcacaccaggaagcgatacacggaagagataagcgtcatcacattcaccaatgtccatcagtcccaccattagtccaccatgagcttcagatttcacctcaggttttgcagcaacatcactttcttcaccgctagtgcaagtacccgcattatcctctttcacaggttccacgctctcatcaatctcaaccttaacctcattagctgcaacaacgccgttacttttagttacatcaacactaaggctcaaagcaaagctatccaatcccgtaagccgcttaaaccgcgcaacacattcttctctcatacaagaagtatctggatcattaatgaacacaatgctccggataaacttaaacttatgcctaacatgggtttcagggtgcaattttcgcggaaaaagatccacgaaaagagggtaatccctgttcgaatcattgcgtttcgcattgaaatattcacgtaactttttcggcttcatgactagagacggatcaacatttctaataatgtgataatacacacgttctagctcagctctcttcataagtgagccacttaactcatctaccacaacattcttcaacgcttgaatctgaaaagctgattgctttggacgatgatgttgttttcttaaatctggtccaaagtaagttcctatgatgaaatgtaagagaaacaacttgtcttcttcaatatccaatgaaattaacacactttcttcttgttcttgagagttttcagctactaaaggagacacgatctcaggcattgtatcactcatatcctaaacacacaacacaacatcaaaagtttgattctttatgagtgtttatacaaaaagattgaaactttaatagaaaatttgaaaaatactggacatgcaataagaaattataaccaaattggataaaaattggacacatttcgtatcaaaatgggtgggaaaaaacgaaactttttaaggagatttaagaaattgaagcaaatagaaacataatttgttgataaataaacgaaattgagataaaatgttactaaccaggagtgtaaatttagggttgctgcttagtgaatttcgttgtctctcatcagagaaacagaaagcgacttgggaaaaaaactcaagacatggcaagaagagggtaaaaatggtattctttcggcactgatttgtccacgtggcgattataccaaatgtacatcttaaagaaaattaagagaaaaaaaaaaaaaaatcaacaaagcttctcggagatttttgccggcgacttctgaaacatcgtctccgatgaggtaaagtaactaatttttctcaaaaattcgtcagttttgtttctactcttgctcttatataacccaagtttgtgtattttcgtttgattctgtgaaagatttaatttttctttatgggttttgtacattttcactgattgaaattaggttacttttggctaaaagtctgaaactttgatgaaatacttgtgtgccaaacttattttcaggtttaaaacttaaacttatgtctaagatagtataatattcattacttggctaaacccttgcttacaaaattgggtcagactcatgtgtgtatctaacattgttgtgtaagaccttttcgataacataaaagaggacaaatgatgaatgttgcctcttcgtttgtctaatttgtggtcatgaaagtataagaagtttccgtttgtatgaatattcgtaagcattaatagtggttatacatcacaagacttagcttgcttattggatcttaaccaatatagttcaatctcttgctctcttactgattctagaatctagctacctctatagccttataatgtttcaaagattaagcctttttagtccgctgctgttttaaagaatcgttgtagtttcgtgagtgattctgttatatagcgaatctgagtcaagtgtatgataaaaggaattgttgtgcttcaggtcttcaagtggtctaaatgggatgagggaaaacaacagttttccggataacacaaggaacccacaaattcttgaagtgactccattgaacagtatgccttacattggtccagtaactcatgcatccatgtcgagtaacaggatgaatgatagtgtagagaaagtaggagggcctgcgatgatatttctgccttctgactcaagttcagagttttctaaccttatcagtcaaacgaaaaccggagttgctctcacgggaagtgctgcaatggggaagattggactaacgattgggttggttgatattgctgaatccgaagactcatattactttcgtgttgcattgcctggtgtttcaagggatgagagtaagtcttaccacctttccatatctttgtgaagtttccaaatgacatgccaaattatcatttctaaagctagttaaagatatttgttcattcagagcaaatattatttgcacatagatttgagaagtttcagccttgtgttataagtgtgtttactcaattatttccttgcacacggtttataagcgtgtttatgaggtgctttgagctttgtttcgtgtgcttttacttgtcttctgctgaatctgacttgttaaatatgcagaggaattcagctgcgaaatagaaccagacggtaagattatgataaagggagcaacaacgacgggggagcagacagtttgcaaacacaatcagatcttcaaaatgctaacacagaacttatgcccaccaggccacttcaccatcaactttcagcttcctggtcctgtgagcaatgaagaatttaacggtaattttgggtcagatggtgtacttgaaggcgtagtgaagaaggtgtactacgaagactgaacagaaacaacaaatggagatggatttgttgagttttaaagtaagctagaatcactgcagcttaagtaggattttctttttgttggaagctacattgtcatcacaaagattgttgattagtttatgttactttgtaaaaacttaactatttgatacttgatatgcctgatgaaaaaagaattggagatgatatggtaagggaattatgataggaaatcaattacctaaaattcaagaactcaaatctttattttgtaaaaatcaacttccacaatacctactacatttgtctactcaattacttaacttctacaagtaatcatatagctaaaaaagcaacaaggaaaatttctatgccttcacaataacactataacttaacttccatacgttattcacctcacctaatattatttatagtttcatgattcaacacatctgtagattaatattctttgaattagtggcataacttatgccctctagggcccttcaccatctgtttccagcttcacttttgttagcaacgaagatgctaggggtaaattcgggtcagatggtataccttagggtatagtgaagaagcttaactatgaagaccgaacagcacaaccgattgagatggatttgttgagttcaatacagtaagctaggatcattgcagcttatgtagtattttcttttttcttgtaagttaagatggtgaaagattgtttattggtttatgctttttcataaaaagttacttgatacgaaatatgcatgaccaaaatattaataattataataaaagtggattattgaaaaaacgttttacgtgatcacagcgtttattctaccataattttgttaaaataactgaatctatagtaacgacttttctgttgaatagtatataatattctataaataaaaacaataaagaaataaagagagacgagagaatttgagtgaaataaacttcacttatttgacttatatcttacaatgagcaaacgaacgtatttatagtagaaatttacgtggaaacaagtcgtaattggataaggagataaacactaaattatttggggaataagtaataatggataatcaccaaaagtattatctactctaatattttcctatttattggtgagttgtttccacatctctatattttaaaaatatattcatataaacttgcggtcattatgatcatgatgtaaaatgtgtaaattcatagacatctcgtcacaaataccataaggtcatcaatcaactattcaaattcgatcatgaatacagtttcatatctctagaggattgaaatacataaaatatgacttaaaacttacattcactcccaaaccataatcagatttttttttttaattttggattattataactaatgtcttctacgtcccacactaacttctgttgtacttcttaatttagttatgatgtgttttttttactattcgttaaaaacaaagggtaaaagatacaaaagagtcttcacacaaaaacacaacaatcactagctcagaagagcacaaggcaactaaacaacaaccccattagccctaaaccagccattactctcacagacgtcgccttgccagcagcaacaccagctgtaaagcttccacctggagtacttgtcgtcaatacaaccaccatccactctttctccgacccaacaccagccccgacatacctcgaatcattaagataccgagcataaccagtttgggtgtaattagttaaagccaaagtcgggatccggttagggatacagacaggtaagatcaatccgtcacgggtagtgtttgggtcgattttgcattcagagagaatgtcctggtagttcgtcagccgtggaggtaccgagccaggagtaaccgtgctcgctgtggtgtggtttgtgcatggctgatcttcgagcttgtcggcgatctcatcagccacacaatcagccttctcattcttggcaaatggaggaactctttgagcagttcggtagctgtttaggccttgaagaagattatcctcggcctctacaacattcaaaacacaaaaataatgatctatgaatgagaaaaattccatctacacgatttaaatgaacatgcatggggatgacattgtaaattccaatattatgagcttaaaagtaattaccaaagacctgaataaatgttattatacatatatttacaaaacgatcatcttgtaatcctttttttccggtgaaaccatcttgtaatctcaaaacacgtattacatatgtaaatatttattcaagaacgagttgtacaaatacataatgtaaatacactaagaaagagatagatagccaatacgtacggttggagacaacacaagtggaaatcaaggagaaaatgagaagatgaatgatgtagaaagagagagacatcttagtaatcaagaccattcttcttcacccaatttctgattcttatatattcttgctttctctggtaataaaagcagaattaagcgataggcaaaggcaaagagaatgtaattttgttggtcctgtactctatttgtttatagtatcttaaaggtctagaattagcttctcttgataagaatttgctaaagtgacaaacacttggcaccgaggaggtttcgttttgccaaaagacgacgtgtattaatgcacatcctcttcacgtgtcatgcatgcacaacaacaaattcgagttaaaatatatatgtatatatacatataaggtatagtttttttttattttcatataaggtatagttatccgattatatagtaaaattaaattttaattaataaatcttcttaacgaagaaatttgtcagtgtgtgaaggagacattgtgtttgtccatgtcatacggatcaccacaaatctggccacgtttaccaacacgtgtatcctcctccgaccatgtcatgttcctcaacctgccacatgtcagatcctatgttgagatatattgctacttcaatgtagcatgttgtatatatggccatgaatgtgttgtgtcgagtgttcacttcgtcaagagtcttatcatcaaacgttacgttctcgttttctcaaattccaaacaataccaagaaacctctacttgaaaagagaagattatcgccgcgtgtgtgcctaagagcgatggcgtctgagaaacaaaaacaacatgcacaacctggcaaagaacatgtcatggaatcaagcccacaattctctagctcagattaccaaccttccaacaagctt

SEQ ID NO: 536 - DNA, 23918 bp, Arabidopsis thaliana
  terpene cyclase TC1
ggatccctactttcacatttctaagtttaggttaaagatgtatttgatgcaatagctccagctgtaggattatctgttggctcagctgtgggtcaatcttctatagctggtgaaatctcacagcttatcaagacacctaaacttgatgcgggaatatgctatgatcccgatgatctttctcaaaaccttgaaagtgctgtggacatattagtagcaacaccaggaaggctgatggatcatatcaacaacaccaagggctttacgcttgagcatttgcgttaccttgtatgcagaatttcctgatttgccttctcagttcttcttgttcttagtttccgtttgatcgatgaagctaattgtttcaggttgttgatgaaaccgacagattgcttagggaggcatatcaatcctggctaccaactgttctgcaactgactcagacatctgacgatagcctatttccttcatttacaccatttgttccttccgcttttggttctctgcagactgttcgtagacagtgagttccgtgttactagcttatttcttttcgtatgctaatagtagtcacataataacatgatcatgttaaacgttgtaatcaaaactgattaaaaagaactaatgtgatgtctgctttaaaatctcagaagtgtggagagaggattcaagggtaaaccatacccaaggctggtgaaaatggtactatcagctacattgacgcaggatccaagcaagcttattcagcttgacctgcatcacccgttattcatgacaactggaggaagccgatacagactacctgagaagttggaatgtcttagactggtatatatgtgcctttaatgtgtcggttttcatcaagtttgtgctttaacagaagatttatctacaaaagcttatctccacaactttcttcccatgtcttttaacagatttgcgaaaccggaatgaagcctgtatatttggttgctctcctaaaatcatgggaaggtgaaaagtgtatcattttcacatcttccgttgagacaactcgtcgtctatgcaagttactcaacttttttggtgacccaaaaataaaagcaaaagagtattcaggtggtcttaaccaatcacttcggaggtaatattcgaatcttgcattacttagtagcaccgtatactatctttggaactcagaactaacgaattcttctcatttattgaacaaaatttgcctgcagcaaagaactaaaagcgtttagaaaaggtgatatccaagttcttgttgcatctgatgctctaacacgtggaatggatgttaaaggggtaacaaatgttattaattatgatatgccaccatttgcaaagaccttcatccatcgtgctggacggacagctagagcaggccaggctggccgctgcttcacattgctgagtaatcatgaggtaaactgatattatgtactacacaaacacagaaacattctttctctatatgcttgtccacgttctctatatgcttgtccacgtatgtgtaaacacaagcttgaggtacctcagataaaagatactaggtaaagcattgtgtctgaaacagggaagaagattcagtttcataatcttgtgctcacctcactgaatcattaatctcttaggataaatgtataggaagactgctggaacccaccctctatctgatcctctgctactttttatatactgaagctcttgactctagctccatttgctcattcggatatataaaaatttcaggtaaggcgtttctcgaagctcctggagaaagttgggagtgattcatgtcctatctatccgatcccgcctacttcattagattccattcgtgccacttacacacccggtaagtacctagccttgtgtatatagctctaggaaacactctgcagatagacatgaaaaataggggagtaatgtggaattgagaatcagcactgctgcttagttgttaaacctcttaatgagcatgtgaatttagatttagagcattactttacaaatgtagatttagagttttatggaaccctgtcagtgcataggagacattagaggccattgaatctgttaactatattttggtaatgatgatgatgaagtcatttctcatttcagctctagagaagctcaaggagttggttgagtcagaagcacccaagaaaggaagacaagcttttagacataattcaagaacgggtaactcccaaaccaaacttaacaaaccgagatcagaagcatagttctcctgtgatgatccctcgggtgtgtcgggtcaagtacaagttattgggtttggatatttcttgacttaacattgttcgttgaggcgaagaatccattgtattactgagaaactacagtataacgctgacacaattcgtcacaaaaattttgaaactatttttgctataaatgtttagtttccaattgcacttcgtagaataatctcagattattttcttagatttttggatattagtatttattactaattgtcaaaaaattaaaatttagaagacttcgtcaaaaaatatatatttacctttatcaattaataaaaaaattcaatcccgaattaggactaatgtaaaaattgatacaaatcgataaattaataagataaaaaaaaattttgaaaatattatataactatatggtctcatcaatagtataaattaataattatataaattcactaatatatatattataaatattatatgtaaaatatgactgtaataattttttttttcagtttttaataattctttgtagtgttcaattctaatattttacaacatcaaaaaaatttgtattgttttttagacttaatcattgctttttacttgtaattactattgattataaagaaaaaaactacattttttatcgaatttttgtaagaatttacaaactttgtacaattttataaatttatcgataaattaatacctttctaaattaatcaattttttgtcccaatattattaatttatagaggtaatactgtaataattttttgaatttacctctaactgaatccttggaccagtggcaatatgggtaaatatctcaaactatgcattgtttcttaattttaaaataaataaataagaaattgtgtttacaacggtattattttgtatgaaacgagagccttttctttcactcagaataaaaccatacctttctcctaatttttcttacgaagatcaaaatcaagaaacgacgacgaaacactccaccactaagattccgtttactatcattgtctcatctcttttttttttggcaaaaacattgtctcatctctattttttgttttttgggtgttttctatcattatctcctctctggttttgaatccttggaacccaagaaaacgaaacccaaatcccaatcttcatcactcaatctcttgtggtaagaaatttcttgggtttgaagagttcatatgtttgtttactcagtttcggttccgtttgtgaaacacccaattgctttcttatttcctttcgcagttcaaaattaaaatcaagatatcgagaaatttttctttatttcttatgagtcaagatcaaaaacccttactttctctttatttccttaggcagagttcaaaatcaaaaccaagaagatatcgctacttgagtctatacgctcccagtcaccaccaaatcaattggcactctgaactgagagaatggaggtgagatatttgatccttactcttacttagttccggttaaagcatatgaaagactcaaatttttttacttttgacacagaggcataaagaagaagataacggtggagacatgatcgacaagtgggagtgacatacaaggggaataggttctaagttgatgtcgaggattggttatcgaaaattatctcgtttgggcgccttgggaaatggcatcttagagcctatcctagtagtcgttcttccaccgagggtctccctagacattgctctttatcttattactagggacaaagaggaacgcaagaaagaaaaggaggaaagaatcagaagtgggaaaaggaaggacgaggcaatgagcatacacaacgacattgtttagcagctccatgagcaaaacgtcctttcatcggaatcatttgacaagggacaagacatgcatgtggaagccaatccatcccaagctgtcttcctctccaacaaccctgatggtgcaaaagaagcactgaactctctgacacaggagaaaagcatggaacaaaatgcatctacagaggattttgagcttattaacaaggaagaatatgatagcaagaataagaggaagagaaggagccgaggttggaaaagaaagcgtgagaagaagtttgtgtaaaaactttagaattataaaaagtgatttctcattaatcatctaatgtgacattacatcagtatatatagtacacaagatgagtaaataactagaatcatgtaaatggaagcttaatcataattatgctcatataaggttaatacacccccctcaagccaaaggaaccaaatgtgagaagaggcttgaaacagatagtcgaccaagaatcgaataaaatggacccggatgcaagggcttggtcagtacatctgcaagttgattacccgaagatacatgtagaacactcataaacccattctgcacttgatcacgagttgtgtgacaatctatttccacatgtttgatcatctcatgaaaaacaggatttccagcaatactcagggctgacttgttgtcacaaaaaagcttcggagaaaatccatagcaatgtgtaaatctttcaacatttgaaccagtcggtgatgtataaccctgaggcaaactcatgtatatctcttcatctaaatcactatgcaagaaagcattagtgacgtccatctgtgttaaactccatccaaaccttgctgctaaaccaagaatcaacttcacactagccaatttagccacaagagaaaaggtatcaaagtaatcgactccttcatgctgtgtaaagcctttagtaacaagacgagctttatatctttctacgagccatctgtagtatacttaatagtataaacccacttacagctaacaacattcttaccttgaggcaaagaaaccacactccatgttttattaagttccatagcttcaagctccacatccatagcttttgtccattgtagtgatattatggcttgcttaaaagttttgggttatgtttcaagagatattgaaaagataaattgctgaaaaggggatttaagtgttgtataagggagaacagatgaaagaggatatggtgtggtgacttttatcggtgatggaggcttagaagtttgaatgagacaattcagataagtaacttggtaccttagtagggtgtttcggtctgaccttaggtactgaaatcactgcagtatctgtagtaacagtctccctagaaccaaatgatgtactaggtggattttgtgtatgatgtgtttgagatgatggtgatgaatgatgcgcagtatgtatgtcagatgaatctaatgcaacaggaataggtaatggtgtaatagatgcagggaaaacatcacacgaatctgtcagatgcattgtatcatatggaaagacagtttcatgaaacaccacattacgagagactgaaatgatattagtatcaagatttaaaaccagatgcataacctaagaaaacacattcatttgcacgttgactggacttatgtctatctttctgtaaagtagaaacataacataaacaaccaaagcaacgtaagaaatcataagcagagctttcttagttaacaattctattggtgacaagtttttcagtaatcgagatggagttctatttatcagaaaaaactgcagttttagaagacttcaaaaaaataaaaaaacttcgtagagttatgaacaaatttgtggggttcaaatgatgtgaattccgctaaattgttggagacatgattcttccatcagatctccacacattttgttattcaattaacaaaaaaaaagatagaaatagaagctgaaataaaaaccaaatatactaattatattgtttcaaagacgaataagatcaacaaacaaagatgtgatatgatccttaaatcttccttcgggatgtgtgtattcttcgccagacctataagtgaactctatcatttttccaaaatcaatggcccgctttagaatttgccgcggcacactctttgttgtctttaatatctcctcgttcacagttgtatccaagtccctagccatcttttgaagccttgtgaaagtttcctcctcggtaactttgtattgcttcatatagtacatgatggcattaacatcaaaccctctgctcatgtcaccctgttagatattactagtcatgtttaacgtataatgtcttgatcactaaccaaacaagaagaaacgcttgatcatacaatttttggtacctcaaagccggctatgtcattcattagacgagcccttttagcctgagcctcaacaaattttggtctggattttagccatttataagcttgttccctagaactttgtcccaacccaagaaaactgcatgctatacttacatacattgttacttcgactcctccaatctccaagtactcgtcaaatgtaggcaccacgtctccttgttcccacttggtaaagcaaaagttggatcttaagtataccttgaactgcttattaggagcatatagaagcacgttaaacaacatctaactatttaattttttgatatttggatgttacttatatatatacactacctcttcaagtgcaccttgcacgtcataagacaatccctcttccattatgcctgcgttttcacactcttcgaaagtattccaagcgaacttgaagacggttttcatataatctggtaaactgtccatgcaatctggatcccatctgtacatgcatactgagatatttgtacgggatatatattcaccaaaaaaatttaccctatgatctattatatatgaaaccatatttctagaaaaatttgatttcttaatgttttgtgttcatatattttatgattttacatagatattaaagaaatagacagaataaatatatttagtcacgtaaagtattggaataattaatgtatttgatttcacttaggatctctaatctatttcactaggattttctttcatggttgggttggcactggcctttgagataagatacgcattcgtgtttggatgatgttacctttccacgcattgaacaagagctgcaacttcagaaacattaccgtatctatcacacgtgtcatcaacaagggtgaagactgtgttgatcttagctagtgaaactctcccaagtgaaaattgtggctcgaaatatatcattattgcaaataaatagcattcgatcaatctatccctgaagtaaggtgggagtttagatgcaaggtcttgctgcttccaccatctgcaaaacatgtcaatgactattgtcaacttgtatcgcaaaaaacatatagctagaagcacgaaaaatctagagtatagtacttggtcagagttttcaattcttgaatccaatttagctgcaaaaacttgaaattgatcttggcaaatctaagtagcatcttgttgtgatcttcttcttgttcatagaaagaaatgtattccctcgcgaatatcatttcggcattgtaatgttgaggcatgcaaagagcatttcgtatacgcattaagatatggggagaacttgctccagctctagctaacgactccaagtttcttgtagtgaagcttaacgcttcctccaagatatcttctcttgttgtccttaagtgagcagcttcatacaaactcaccatgcccttgacatcactggttatagattccataaacttttcattctcccctttgaatctcttgaaaacatctattggtcaataggagaatcttgttaatacatatgaatcgattacaaaaaaatgtactggtagataacttttaccggtagacatgttgtaaccgtatgtcctgaaaacccaaaacatgatggaaatcgtgtacaaatcatcttcaccggctatcatctcctgtatcttttcaaaaccctcttctagactctgctcaatctcatcttcaaagtgaaacgctacaccaaggctcacaagcatatatatgaaaagaatcctcttcttggtcgactcaatgcttttcgaagaaaacatgagcatctcccctacttccggctttagtctctcaatctcttgggcaagggcattcatttcctaacaataatatcatatgttcatacccgttacatcgatcttttacatttattatatatatgtttgtcagtgtgtattatagactcaccgagacatcaacttgagcagagaggaaatggtgaccccattttgaaagcggcagtctcttgaacttgcgattactttcttgatcatgacaggcccgagtaggggtggccttcatgcgaacaagctttccatgctgacctgaaaatgacttgtggggaaagctagagagttttcttaccgaaaataaattggaacgtaaaggaagagagagtatagatccataagctgatatgcattgcatgtttactactagtgatatggaatacattttcaccaccaaatttataggcaaaacataagcgttttcattaagtcatcttttgaaaagttttggaagaatgtatattaatacccccatatttatcttcttcagtgtataatacaacctatgttgggaccatgatattttctgaatttatagtgatattagtttatctttaaattgatatttattaatctatatagatctttttttaattatttaattttttaaagaatacgagttgacacaattcaatatacatcaaattaatgacttggatgttgaaatttgtgtagtattagaattgaaaatttaatatttcaaaaaactcatttgacaataaatcacaatgactataactgaattcatttatataatagatatacatacatctaagtttatgattaataacctcaactatcagatttttaaatgtagtagactattgaaatgaaaataatgcagattaagaagttgtatacttataaaaacttatgactaattgtattaggaagttataaacgatactacaatatgatagttttaaaacacaacataatttaatgaaaattagagacaaaatcattgtttgatgtaataatagttcaagacaaactctaacaaacattcaatagttcaaaaaatatttaaactatagattatatatattatcgtatatatattatatttttgtggttattaatttatgatgttattaaaatcatattttttatatagggttttaaaaaattgttaacttattattttatcaaattatgttaaattttacattcacacgacttgaaactaatataatattatctccttgtatttattaatttatcaaaaattaatttgtagaggttttactgtaaaacatgtttagtttttcattttttaaaaaacctccaagtggcaaaaataagatccatctccatctaaaaaagtgcaaacaaatctccatcatttaaaaatcaacgttaacatccatatctattgttgttgttttttacttctttttctcttggtcaaactctacgttagtttgatcaataaatatgacaagaatttttgcagtctcataggcgtctttgtaaaggttagttagcgtctacataattttccgaaagatataattttcttgagatacagttaactcaattactgaaatgtaataactttctaaaagttgtggctattaaacaaaattgtgaaaaaatttaaaccaaaagccacttcaaaaacaaagaaaaccataaccattaatcaaaattcttttttttttgttaacaagtactagttgcattaaattgtaaacatatggtggtgttgtatatgtttgatacaaagaacctatataacaaaggcttgttgggatagtgcatctgccacattatttcttttccgattgacatgtccatagatgagtgtgatagcttcaacatccaatatcgtataccaccaaagactgaagagtagtaccaagaatatttatatatatatttatttatttatttattttggtaaggagaatatttatatcatgatcccaccatactttaattgttatgaaaaaattttaatttgattttcataaattttatagtttagttaagtataaaaccacaattttttttctttcaaatattatttttggagaaaacccccaaatttaaaaggaaagagaaaaaatcaaatcattcatctttgagctttcttttcttctacagaaccctaatttcatgttctaggtgtctctcgaatggttctcatctcattgattactcaatctctagggtttagtggttcatccaaattcgtaccctaatgggtgccgtagcgatcaatcgtaaacgcagcgacgaatccttcaatttcattaatcaacaatcaaccaaccctttacgaaattcaccgtatttccaagcttccaagaaacgaagattctcattcgctatgtctgaagattctggtaagccagcgtcttcaaacccaacaatttcgaggatttcaaggtaccctgatgctaaagctcctcttagacgagagattcatgctcctagtagaggaattcttagatatggaaaggcaaaatctaatgattactgcgaaaaggacgcaaatttctttgttcgtaagtatgatgatgcaaagagatcagctttggaagctttgagattcgttaataaaggtaaagactttgttgatttgggtgatgaggttgaaaaggaggaagttgtttctgatgattcaagtgttcaagcaattgaagttattgattgtgatgatgatgaggagaagaagaatcttcagccttcgttttcttctggtgttactgatgttaagaaaggggagaactttagagttgaggatactagtatgatgctggattcgttgtcgttagatagagatgtcgataatgatgcttcgagcctcgaagcttatagaaagcttatgcaaagtgcggagaagaggaattcaaagttggaagctttgggttttgagattgtgttgaatgagaagaagttgtcactgctgcgtcagtctcgcccaaagactgtggaaaagcgtgttgaggtgatgagatttatactaatctttcttgaattggatataattaatgacattgctttgtttggattgtttctctaaaatgcatatgatgttatcgcctactgtttgttagtgtagactgaagatagtacaatacttgttggctttattggttattaagctgcagttattacttatgcacacagagtcaaagttcttctacttattagagtatattgtaatcttagcgttgagatcgttagtgtgtttctatgtttattgttgttgttaacactatgtttgttgtgttgttgatataatgaaggtgcctcgtgaaccttttattcctctcacagaagatgaagaggctgaagtctaccgtgccttttctgggagaaataggtatggtttcttaagacgctctagcatgttgagtgattttttttagtctaaccaaaaaccaaatgtctcccatttttcagaaggaaggtcttggctactcatgaaaactcaaacattgatattactggagaagttctgcaatgccttacaccatctgcatggctaaacgacgaggtacaacttgttccataatattctacacaattaagagctcttaaatcacattttcttttgctgatttcttgttctgttttataggttatcaatgtctaccttgaactactcaaagaaagagaaactagagagcccaaaaagtatttgaagtgtcactacttcaatacctttttctacaaaaaggtttgttttctttctgctcagatgatttttaacaaaaatttgatcctttttgcctcatgtcagttcgactgagtagctgctacttgcttccataaaaatgataagcagtatgtttaagtgatctttatgataagattattgatatatttggccttgtttctccccatggtactcagttgtctctggcttctgtatcccatgaatggcagtgagtaaccaagacaagctgtggccttcttatacgttgatgaatcctctggcacttaaatctgtctttctttaattatttttttcagctggtaagcgattctggttataattttaaagctgtcaggagatggactacgcagagaaagttgggatatgctcttattgactgtgacatggtaattttgtcgaagaacctgaatttgaagattctcttgttaatattacgcatgtagtccaatttatttatgtttaacttagtctgtgccctctgcagatatttgttcccatccacaggggtgtgcattggaccttggcagtaattaacaacagggaaagcaagctcttgtatcttgattcactgaatggagttgatcctatgattctgaatgctctggtatgatttaatttctaactcttattcgctttatttagtctattaataactgacatgttggatgcattaaaagatattagatgctgataaatctttatcatcatttcttgattctgaaatctgtttggagacattatggagatgccagaagctgttattgctttttaaatcggacactactgtgaaagtgttctaaccatatatactagtcgttatagctaatgccagatctgatattctgcttcaggcaaaatacatgggtgatgaagcaaatgaaaaaagtggaaaaaagattgatgctaattcgtgggacatggaatttgtggaagaccttccccaacaaaagaatgggtatgtaactatgcttgaacttgctatgatccatgatcatgtgaaaggaactatcttgttaaagagataacctctgtagaatcagatacttgtcttctgatgtgggaatatgggtttttaagacaaaggatagatctggtttgagattgattaggagaaattcacctgatataaattttgataatggaatcaacaagggtataacttaactgttcttatgctctttagcactctggttaagctctctgctaactctatattgtttctttgttgcaatcttttatattctcaggtatgactgtggaatgtttatgcttaagtacatcgattttttcagcagaggcctggggctatgtttcagccaggtaagctatcagaatccaaatctctgaatgcctcaagaaactgtagttgagaataaaaactggttgtcttgaaacaatatggaattagtatatccccctagcagtttatgtaacttgtaggatttaggcatttagcgtaataacattgtattactttgcaggaacacatgccatacttccgactcagaacagctaaagagattctgaggctacgagctgattgaagttgcttgtgctaatgttttttcggctattaggaatactatttttggttgccattgttgatttgttcaaactttaaatcccactccttttaggcagtgaagcactcggctttaaaagcagaggtaaaaactgagtcaagcccagagctcttagctcgttccgttattgtatttttttccttcttcttgttttaaaatgtagatgaagcgttttggatctctatgttggttagtctagctgaagatatatgagatgttgaaaaccttatttatttctctccggtcttgaccagtgcgaacgcaatttaaagtttccatctagtatcggttcgatatattttcctctgttcaatagccaaaattccatgaataatctcttgaaagcaaatgttttcgatatacaaatgttctgcacaatttccccaatacatacacgaatatgttacaaatatacaacaaactgctgtttgtgagtacaaatgttgacaaggacacagaaaaaacaaaatcccaaatgtaacattgacatattaaaacccactcccaaaaacaaaaacaaattccccaattcataaaacacgagaggaaggaagacttgtgtgtatctcctaacaaaaactgactggaaggcaaactaacttccactgcctttcctagcgcggaactctcttccggctaagtatctcctgttctttcagacggtgttggaaccgagcaagacgggcttgaagacttacaagaccagctgctttacgggacaacacaaagctcagctgtgtaacatagttgtcaatcatgctccctggccgatccaccttcgctagtaatttcatttcctacaaaaaaaaacatgaaataatgttaaaacaatcacaagacatatgagccataacctcgtgaactatttccattgtatcctcgatctcttttctgtgtgctgtaattaaggtctcttcttcctgccagagtttaaacaaaataattaccatattacaggttttctaaggttattcgtgagcgatattcataaaattccctcacgctcatagcataatttagaagtatagaagggtcaaatggctctttacctcaagcaatgcatcaatgttttcatcaagagaaggctccgttgtttcatactgccttgaagatgtatcgcttgtgttctgactgctagccatattttgttgtctagaatttgtcatggcagggacatcagtcttgagaataagatgagtgaatcctttgactagtggagccgccaaaagaagattttaaaatgttaagcataaatcatattccttaaatgttaagtgaatcctttgactagtatagtatagtgtctggtttttcattagactttctgagatgagaggtatttctattaaaacttaagttgaaggttttaaaatgaatcagccaaaactgcagggtttgtttcattaaaatcccaaaattgtttcgtatacatcatattacccactgaggactctgctctttgtggaaatgctaaattagccccaaacctttttctaagtcccactttgaattctaataagaacgaacagatcgcgggaaatccaaaatgatttgaaaccttttcacctgaatttctgtgaaatccaaaattctctctctatcagtagagaatcgccatggatgaagagcttctgctcactagaatccttgcaggaatcgaaggaggagacgatgaatctgactatcatgaactcgtcacggatctcaaatctctacttgatacagacgatgatgaaattctcaatcgattctacggtagtctctcctcaatggcttcttcgtttctccgctgtatctccgccgccatggattctccggttgaatcaggccgtcttgctattttagcctccgacgcttatctcagtctgcttctttccacgaattgccccgttttcactttcttctctccgattgcgtttctttctctacttggctcaattcgccgctacctcaaacgccgtgatgattccgccggtcaagggagtaattcgcagcgagagaaagggaataagaagaagagaggacgtggtaagaggaatttagggtatgaagatggggaagagactgaagaaggtggatttgatgcgaaattgatgtttatagtgttagagaagcttggctcggttctgagttttgttcatttagatagatttcctgatagtttgaaatctttggtacaaactgtgagtgagattcctttattggcgttggagcactctggagttttgaattatgatcgattgatggaaatgtgtgggaagattctgggaggagtgttgaattctgaccatggagatatggcactcactgctgctgagatttcaaagtctttgacaccgttgcttcttatggggaaacatcaagcgagaagttttgcgttgggatttgtgtcaaggaaattgatgagtttggctaaagataaccctgaattgaaaaaagttgtgtctaatttgcctaagtttctggttcataaggcacctgagaaggccgagccgcgtggatttgcagtggaggcggtactggagattgtaaaggcaatggaggttgagggccaatcagagtttgttgattttgtaatgaagatgtgtcaagggaagtctaattttagagtattagctgttgatattatacctctgttgataagctcattaggaaaccctctaggagatattagttcagagaatgggttgaaagattcgtggggcttgggttgtattgatgctttagttcagcggtgttcagacacgagcgctttgattagagctcgagctttgtccaacttggctcaagttgtggagttcttgtctggtgatgaaaggagtaggtcgatcctgaaacaagcccttgggtttaacggtgagacttcagagggaaaaggtgcagtaactgaccttttgaagaaaagatgtgtggatgagaaggcggctgtaaggagagcagctcttcttctggtgacaaaattgacatcgcttatgggtggttgctttgatggtagtatcctaaagacaatgggtacatcttgttctgatccgctaataagtataagaaaggctgcagtttcagctatttccgaggtatgttttctgtaactcagtttcttctttctcatttacccgatggtaatatgtgtagagttagtataatttatacgggtttgctttgaccttaattagctcaaagttaaagagaccaaatgtgcaagccaaaaatgtttttagatgaatgaatgggaaattacatagcaactgcttccgtcggtttcatactaaaatcagataatctttatactttaacttatccctgaatataggtcaggcactcaggctaatgacttgttatcatatttctctgatgatgcaagttcattgtcttctgttcactgtaggcattcagaatatgtacagatgaaattgtgaccactgaatggttacattctgttcctcggatgatcatggacaatgaaactagcatccaagaagaatgcgagaatgtctttcatgaattagttctggagagaatattacgagctggaaatgtgctttctccagacagtgcttctctccctaacaaccggaacactacttcaaaagatctagacagagacattgaagccttgtttccagaaggagttttggttctcttaagggagctttgcaacagtgaggtttctccttgggttacgaaaatatgtggaagtttgggaaagaagaagcgactaaaaccaagagttgcccttgcgcttcagtgtatcataaaggaatctgaatcactgtggttgagtcgttcaatgccaataaatagatggacagctcctgctggtgcttggttccttctatcagaggtttcagtttatctttcaaagtctgtcgaatgggaatttcttcaccatcattggcagttgcttgacaagaatgacgtacaaggtttgtcagaattctgtttatccatctataaacatctcaatcaactgattcatgtctttacttgttcctactggtagtgtgattttctggttttagtcctaacttctaccctaattaaaccaattttcatgaatgtatgtatgataatttggctatttctgaagggctagatgaacaaggtgatgaacagggggtcgagtgtaattcttctacatgggctggcgatcgagtttgtcttttgcaaacaatctccaatgtttcccttcagctgccagcagagcctgctgcagatctggctgacaatttgctgaagaaaatcgaaaattttaacctgcattctgctgaggtaatgataaatatttaacctgatatcttctatataaaatcaagctcatgttttgaaagtacagaaagttactggtttttgtctagaaggatgtattctttcagattttgatatttttttggtacttttctgtaacctgaaacttgaacgcttgaattgagcagatcattattcactggtttgaaaatggttgcttcgtatatggttcatctatcttcatgaacttagtcaatgccattgaatgacaggtcgatgcacatgtcaaagcattaaaaactttgtgcaaaaagaaggcaagcacctctgaggaggccgatatgcttgtcaagaagtgggtagaacaagtttcattgaaagcatctaaggtcactgagaagtacatcgagggggtttccagtcataatcattcttttgttacaccagcaacactcggaagtagaagaagcaagagactggatactgtgtccaagaaattatcaaaagcagtcacagcagtatacaccattggatcttgtgtcattatatatccttcagctgacacgaccaaaattgttccgttcttacatactgtcatcacttcaggaaattcagactcaaagctgaaaaacaaactgccgcaagctaatgtttgcttgaagcaaaaagctcctcttctctatagtcagtcttggttaaccatggcgaagatgtgtttggctgacgggaagcttgctaaaagatatctccctctctttgcacaggtctgtctgcatttgctgattcatgtgtccattttatcattttgattatttctggaaaggaaacttttcgttccaggaacttgattcattggatggtagtctcctttgtctcttcaattttttttaacctatgtgaacccgttgatgccttactcttgcaggaacttgaaaagagtgattgtgcagccttgcgtaacaatcttgtagtagcgatgacagacttttgtgttcactatacagccatgattgagtggtatttcattcacagaacattaatttttcaaatgttaaacatgattgcgacattctaatggtttgtttacctggatagttacataccgaagattactaaacgtcttcgggatccttgtgaagttgttagaaggcaaaccttcatacttctctcaaggttactacaggtattgctattctccacagattctttatcttctgtttttaaaaagtattgaattgacaatgaataagcaggcttgttttcttgattcagagagactacgtgaaatggagaggagttctcttccttcgattccttctatcgctagtggatgaatctgaaaagatacgtcgacttgcagactttttatttggaagcatccttaaaggtatgagaactcacgtgagcaaccatgaaatgcattctttcattcccatgttattgaaaattcttacagagagacatgatctctaggatttttgattattgttacgccccatgttgcttatagtaaaggcgccacttctagcttacaacagtttcgtggaagctatttatgtcttaaacgactgccatgcccacactggccatagtaatccagattctaaacaatcaagaacaaaggatcaagttttttctatcaggtacttgtgttaaagttatatagtctatgctcatacgcaaacttgacattttggtgtgaatgatcttagtgattatctttgtttcatttgttctgtagagggaatgatgaaagggctaggtctaaaagaatgcagatctacgttactttgcttaaacaaatggccccagaacaccttttggccacattcgccaagttatgtgcagagatcctcgcagctgcttctgatggaatgctcaacatagaagatgtcactggtcaatcagttctacaggtaacttccaaaatggctacagagccttttttcttcttgtgattgccgatttttaactcgttttgtctcggtgtaggatgcgtttcagatcttggcgtgcaaagagatccgtttatcagtttccagaggagcatcgtcggagacagcagatatagaggaagaaggtggagatgcagcaactgcaaaaggaagggccataacgcacgctgttagaaaaggtttgattcagaacacgattccaatcttcattgagctcaagaggctattggagagcaagaacagtcctctcacaggttcgctcatggactgcctccgtgtcctcctcaaagactacaagaacgagatcgaagaaatgcttgtcgctgacaaacagcttcagaaagagcttgtttacgatatgcagaagcacgaggctgcaaaggcaaggtccatggctaaccaaggggttgcctgcgggacaagtcatagaaacggtgaacctgaagcatcagcagcaagcgaggagaatgttagagattcgggattggaatcaagagtggtttctgcggctgctgatgtggtggcggctaaggcagctaggtcggtgttgagagaagtgaacggtggagctgcaacgccgcctctgagcgcaatgagtgttccgaagctaaggtcgagccgtggagttagccagagtggtcgaccatcagctgatgtgttggagtctctgagaagaagaccaactttcatgtctgatgatgagagttagaacttaaaaatgagactgtagaaaatagcttttgctgtaaatgcatgacttcgatttttctttttgggagattagatcgagactctattaaagtctaaatcgtatttataaaccgcataagacactaaaacctggtgtgtgtgtgtgtgtgcgcgcatttgtttgcttgctcatgtttgtccttgtgtgataaatccatccctgccctcaaattgatttatgtgttgtatgtgttgattttagtgataacatctcaaagtgattaaatattttcaaaaatgctatttgatgtctataacggctttaaaacttttgcaagttcattagagctatctctagcacatatatggcgcttagagatgttacgaatatgtaagactgattacatatctctttggcttaataaatataagtatttgtgttgaactctttatcttcttcttgaagatgtcttatgggaaacatgttaaatggatagtaaatgagagattcgaaaatatagtgtgagcttccttctttggtttatgcattctccatgtggggggcaaggtttttgaagatttatacttttgtggcaaatctcttgtttgaatactccatgggagtctctcatcaaaactatgctgcaaaatatttgaaaatttataaatctattgtctttgagaaagtgttacaaaatttatgacctcaataatattgcatgaaaactttcatacatcatttggtatatgtatgtttaagaaaaggtaaaaccgtaattataaagagaaagaaaatacaatatcttaatacatatcaatctaattactcattaaccatattaagaaaatatgtgtctttattttttccttttaacataaagcttaaaaagaagatttgtagccagaaaaattaattgtgttcatttcccttttaaaagaatttttcggcgcaacaaaatcgtgaaattgatataaataaactcgagattattaatataaccctttttcacttcacttctctttctctctaaaccctaaaagaagaacgatgccggctccgacgacggagatcgaacccatcgaagcacagtcactgaaaaagctcagtctcaaatccctcaaacgatcacttgaactcttctctcccgtccatggccaattccctcctcctgacccggaagcgttagtcttcttcgatccccaattttcgattcgaatcttcattttcttcactaagtttttatgatttcttcgttttttttttttttttttgcagcaagcagattcgtctcagccataaggtaaaacattgagtctctcttaccagtctttagaaatttatttcagttattcgcttttaatgtctattgattggattttggtttaaagcttcgaactttaggtttattcaggtttttccataattgttctaaatcttcaggttttgttaccaataatagtaaagatggttgatttacttagactctctctctctctctgttgtgtatgttactgattttagaagttttctttgtacagatgaaagttgcgtttggaggtgtagaacctgttgtgagtcaacctccacgtcaacctgaccgcatcaatgagcagccaggaccttcaaatgctctttccctcgcaggtgtttttcatatcactatgtcttggtgaaagataaaaacttgtttcttgtttgctatttgcattcttatttgtattggaagggataaaatcatctgcttgatgaattctgcagctcctgaagggtctaagagtacgcaaaagggtgcgacagagagtgctattgttgttggtccaactttactgcgtccaatactgcctaaaggcttgtaagtgttatcttttgttgttggtttcgttgatctgaatgctaattgatggttctactttatcgtgaggatgctcataaaagaattcggttctcgaattgaaggaactatacaggttcctcagggaagagcaccaccattatacctgcaaatgtatcttcatatcaaaggtttttttctcgtcctcatacttgcttttctttatctggattgcaatacattaatggcagctctaggtagtgtaggtagttcatgggcatgcaaattagacttcccccaatctgaatttttttggtttgtccttataatgtagcttctaattctgattccttttttgttgttgcgttcctttgcgtgttacagaaatctgtcaactgctgcattaatggagagaataccaagtagatggccccggccagagtggcatgcaccatggaagaattacagggtaaaatccgtggctcagcattgttgctgcatcatacggattttggtcttttgttggtctccaaaaaactctggtttgaggagttacttaacttacgattaattattcttttcacaggtcattcaggggcacttgggttgggtcagatctgttgcgtttgacccgagtaatgaatggttttgtactggttcagctgatcgtaccatcaaggtagcagagatgattgcttattcaatatgaattgtattttttcgaatatgttttcttgttatacttataagtcatgatacaagacttcccttctatggctagttactggagcttagtttagtgcattgccaaaaatccactactttggcgattgtagaagcagttccgactttggtatgtttactgaatttattacttgtgttttattcactagatatgggatgtagcaactggagttctgaagctaacacttactgggcatatcgagcaagtacgaggttagcctttcaaatctgttctcgtttattaatatttgttagacttttcaataaataacactctcgggacaagttacaagtttgggctcttttgttttgaattttgttacaggcctcgctgtaagcaatcgacatacctatatgttctctgctggtgatgacaagcaagtcaaatgctgggaccttgagcagaataaggttacaactctattctcttcattatctggatttctcatatctaatgctcttggaatttttgatttgataggttatccgatcttatcatggtcacttgagtggtgtctattgcttagctctgcacccaactttggatgttttattaactggggggcgagactctgtctgcagggtaaggcaaaaatatttatatccatatttatatatcttctcgtttgaattcttgcactttgctggatttgtagtttaaaagtccatgtttacttatttgcaggtgtgggatattcgtaccaagatgcaaatttttgcactctcaggacatgacaacaccgtttgttctgtatttactcgtccaacagtaagtctcttttaatatggacttgttgttatggtttttggatttcttgctgaatctttttataatagtaactggaactcactttgatctgtgttgttgcaggacccacaagttgtcaccggatcc

SEQ ID NO: 537 - DNA, 1940 bp, Arabidopsis thaliana
  terpene synthase/cyclase family protein
atggaagcagcaagaatgggttttcgagctaaaactctccctcaccttggcaacggtactcgacttcctcttaagaccaaactctcgctctttcctatgcatttgcttcaaaaccacactactctttcccggagatcaacaaaactcaacttatgtgtcaaggcttgtagtaagactagtggtgttgagagtagtcgtcccttgcctcacagtgctcccgatctttggggagatcacatcctctctgtccccaccgaaaactcggaatttgatacactagagacagagattgaatcaataaagccgaaagtgagaaacatgctaatgtcgtctcacaagactgacaaagagagaatatgtctcatacacttgcttatttgccttggtactttccattactttgagaaggaaattgaagagattctagaacaggcttttcggaagttggacatgctatttacagacgaagatgatttggagacaactgccatcatgtttgaggttttcagattatatggacacaagatttcttgtgatgtgttcgatagattcaaaggtgttgatgccaagttcaaggaacatctagtcagtgatgttcggggaatgctacagctgtacgaagcagcgcatctcgcaacacccttcgaaactatattggacgaagccttgagtttcacaaggtatcacttggaatctttggccggccaacaagctacagctcctcatatctcaagacatatacttaacgcattgtataaacctcggtttcttaagatggaaataatagctgcccgggaatatattcatttctatcaaaaagaaggtcatgatgagacattgctcaagtttgcgaagctcaacttcaacttttgccagctacattacgttagagagctaaaaactctcaccaaatggtggaaagacattgatcttccatataagctaccttacatcagagacaggcttctagagacctttatcggtgtcatggcggtgtatctcgagccacactattcacttgggagaattatagccactaaagtttcccaagtgatagtagttatggatgacacctgtgatgcatatggaactttctctgaagttagaagtcttattgattctttggaaaggtgggatcctggtgccattgacaaactaccgagctgtttaagaatcgtcatccaaagtatagttgaaacaatggaagatattgaaagagaaatgaagccgcgaggaagatcctcgagtgtgcaagacaccgtagaagagattaagatcatggggagagcgtacgctgaaatatcaaaatgggcacgagcaggtcacgttccaacctttgatgactatattgagcttgggcttgactcgtcagggattagatgctttgcaatgtacagctttatatcgatggaagattgtgaggagaatcaaacgaacgcgtggttcaaatccaaacccaaaatgttacgagctttaagtgttatatttcgtcttacaaacgacatagccggcttcgaggaggagatgaggagaggagaagtggttaatggggtgaactgttacgttaagcaacataatgttaccaaggaattggcggttcgagaaattaagaagatgattagagataattacaagataatgatggaagagttcttgacgataaaaagtgtgtcacgtccgattctggtccggtgcttcaacattgtacgattggtcaatctgtattacgaggagggtgataatttcaccaatcccaatggcaagctcaaagatctcatcacatctttgttcttccatcctcttccgctttgaagacttggctccttgccgaaaaattcatctacatttctctttccattattattgatgattgttaatttgctctatgcacatatttttccattaaattttaattcctggggtttcaattagtttttact

SEQ ID NO: 538 - DNA, 1812 bp, Arabidopsis thaliana
  terpene synthase/cyclase family protein
atggaagccataagagtttttggaccaaaacttggatctagactctctattcgttctcacaccactgcatttccggcatgcaaactctctcgctttccgctaacgtcatttcccggtaagcatgcacatcttgttcttttgaaggccactactattcctctggcgtctggtgacaaagaaaataatcgcaaattcgaaaagttgggtccttctgaatggggcaatcaattcctttttgctcatgttgatctctcagaaatggatgcgcttgagagagagattgaggcactaaagccgaaagtgagggacatgttcatgtctttcaaaggaatgaagtcgaacaagaagaatttgtttttgatatatttgcttgtgagtcttggtctcgctcatcatttcgaggatgagatcgaggagagtgtcaaaggttgttcccaagagatggtggagatgatggacggtgaaaatgatttgtacacagtttccatcatcttctgggttttcaggacatatggtcacaacatttcttctgatatttttaacagatttaaaggacacaatggaaagtttaaggaatgtcttgccaccgatgctaagggtatcctaagcttgtatgaagctgctcacatggggacgacaaccgattatatattggatgaagccttgagcttcacattgagttacttggagtcgttagctgcaaatgggacatgcaaacctaatctcgtgaggcgtatacgaaatgcattgggtcttttgcagaacaagaacgtggagatattagtcgcaaaggaatatatccggttctacgaacaagaagaagattgcgataagactatactcgagttttccatgcttaacctcaaattcctacagctacattaccttcaagaactcaaacttcttacaaaatggtacaaggaacaagactttgaatccaagttgccaccttactacagagacagaatcgtggaactgcacctcgctacgctagcatacatcaatccgaaatactcacgtgtgaggattattctgactatgatttacactattcaaataattctagatgatacgtgtgacagatatgcttctcttcgtgaggtcgaaagcctcgctgcaaccatcgaaagatgggatcacaatgatcatgccatggagggactaccggattatttaaaatctgtggccaaatttatatttcataccttccaagagtttgaaagagaagtgtcgtcagaatcaggaggatcttacagcttgaaagctacaattgaagattgcaagagaatgatgagaagcaaccttcaacttgccaaatgggcagtaacgggtcacttgcctagctttgatgagtacctagatgtcgctggagtcgagatcgccgtatattttaccgtggcaggtattttgttgggcatggaaaatatcaacaagaaagaagcttatgagtggttgatatttagagacaaactcgtaagagcaatgtctacaaaagcacgactggtgaatgatttgtttggctataaggatgacatgaggagaggatatgtcacgaactcgatcaactgttataagaagcaatatggagttaccgaagaagaagcctttagaaagcttcatcaaatggttgcggacggtgataagatgatgaatgaggagtttttgaagccaatcaatgtgccacatcaggttctaaaagcagtcctcgacactttacgtgcaattaacatttgctacgacaatgaagatggatttacccgactcaatggtaatctgaagaactacatcacgtctatgtacgttgatctttga

SEQ ID NO: 539 - DNA, 1806 bp, Arabidopsis thaliana
  terpene synthase/cyclase family protein
atggaagcaacaagaacgagttttggtcttcataacgcccctctctgccccacaacaaacccctctctttttcctcggcgttggcttcacaagcacactctttccttgaaaccggcaaaacaacaccacttggtctgcgttagggctactgagagtaatgataatcttgaaagtagtcgtcccttggcacacttttctcccactctttggggagatcacttcctttctgttcccctccatgtcgctgaatttgatgatttctcaagagagattgaagtgacgatgaagccaaaagtgagagacatgctcaagtcttccaaaaacagcgacaatgagaggatccgtctcatccatttgctaatgaacctcggaatcgcatatcatttcgagattgagattgatgagattcttggccaagcttttgggaatttggacgatataatagccaaggaaaatgatttggaaacaatctccaccatgtttgaggttttcagactacgcggttactatatgccttgctatgcattcaatagattcaaaggtgaagatgggaggttcaaggaaagtctagctgaggatattagaggaatgctacagttgtacgaagcagcacatctcgggacaccatctgaagatattatggacgaagcattgagcttcactcggtatcgcttagagtcgttgacaagtaatcacacagcaactgctagtccccatctctctaaacatatacaaaacgcactatatagagctcgatatcataacttggagatattagtcgcaagagaatatatctctttctacgaacaagaagaagatcatgacgagacgctgctcaagtttgcaaaactcaacttcaactattgccagctacattatatccaagagctaaaagatctgaccaaatggtggaaggagctagatcttgcatctaagctgccttacatcagggacagaattgtagaggtctactttggggcactcgcattgtattttgagccacggtattcactagggagaattatagtcactaaaattaccatgattgtgactgtttttaatgatacatgtgatgcatatggtactcttcctgaagttacaagcctcgttgattctttccaaaggtgggatcttggggacatagaaaagctaccaagttatgtaaaaatcgtctttcgaggtgtatttgaaactttagaagagattgaacaagaaatgaggccacagggaaggtcacgcattgtgcaagtagcggtagatgagatcaagaagttggggaaagcatacttggctatctcgaaatgggcacgcgcaagtcacgtgccaacctttgaggagtacatggagtttggtatgcagacgtcaatggatcattttgcagcctatagctttatcgcgatggaagattgtgatgagaatcaaacgtgcgagtggtacaaatccagacctaaaatgatggaagctctgaatggtgtgtttcgtattaagaacgacataaacacctttgagcaagagatgagcagaggagaagtggctaaagggctgaattgttacatgaagcaacatggtgtttccaaagaagaggcgattggagagatgaacaagatttatagtaattattacaaaataataatggaggagtacttgacgacaaccgctgtgccacgtccgattctggtgcgatgcctcaacgtttcacgacccatccatcatttttacaaggagagagatgaattcacagatccttatttcggaatgcttaaagaagtcatcacttctttgttcatccatccaattcctctttga

SEQ ID NO: 540 - DNA, 1815 bp, Arabidopsis thaliana
  terpene synthase/cyclase family protein
atggcagtagcaagaacggtttttgggctcggaactctctcttaccttcaccaagctcctctctttcttaagaccagtcaatctctctttcctcgcccttctctttctctgaaacctatgaagcacgactttgtatgtgttaaggctactactaagagttcgactagtgatgatcttgagagtggtcgtccttcgatactcttttctccctccatttggggagattacttcctctcagtttcggttgacgattccgaatttgatgacatagcgagagagattgaatccgtgatgaagccatacgtgagagacaggctcatctcttctcacaacagcaacaaggacaagattcgtttaatccatttgcttatcagccttggcatctcgtattacttcgagagcgaaattgagatgatcctaaacaaggcttttgaagagctggacatgataatagccgaggaagacgatttggaaacaatctccatcatgtttgaggttttccgactatatcaacacaagatgtcatgcgatagcttcgtaagattcaagggtgaagatgggaggctcaaggagagtctagtcggggatgttagaggaatgctacaattataccaagcagcgcatcttgggacaccctctgatcaatatataatggaggaagccaagagtttcactaggaaccacttggagtctttggtagagagtactactattcctccacatttctcctcacatattcgtgacgccttgtacatagatcgatatcataacatggaaatactagtcgcaaggaaatacatctctttctacgaacaagaagaaggtcatgatctgacgcttctcaagtttggaaagctcagcttcaattattgtcgtttacattacatccaagagctcaaaactctcaccaaatggtggaaagatcaagatattccctctaaccttccttgcgtgagggatagaattgtggagacctatttccctacattgggactatatttcgagccacgattttcacttgggagaattataatagctaaaatgaccatcatcgtggttgctttgaatgacgtgtgtgattcatatgcaacttaccccgaagctaaaagtctcatagactctttgcaaaggtgggatattgaagcgattgacgaactaccaaactattcgagaatagtcctccgattaatattggaaactataggagagattgaaagagaaatgaagccccgaggaagatctgctagtgtacaacacacgatagatgagactaagagcttagggagagcgtacctagcattatcaaaatgggcaagtgaaggctatatgccaacctttgatgagtacatggaggttggggaggtcactggggggatggatgattttgctttgtacagctttatcgcgatggaagattgcgacgagaaaccattgtacgaatggtttgactccaagccaaaaatattacaagctttgagtgttctatatcgtataaacaacgacatagtcacctacgagagagagatgagcaaaggagaggtcgtgaatggggtaaactcttacatgaatcaacacggtgttactaaagaagaagcggttgaagaattgagaaagatggctagagataactataaaatagtcatggaggagttgttgacgatcactgatgtgccacgaccagttttggtgcgatgcctcaatcttgcacgcttgttcgatgtgttttgcaagcatggtaatgatgaattcacctatccgcatggaaatctcaaagatctcatcacctctatattcatccatcccattcctgtttga

SEQ ID NO: 541 - DNA, 1803 bp, Arabidopsis thaliana
  terpene synthase/cyclase family protein
atggaagccataaaaactttttcaccaaaatttggattccaaatctctctttctcctcgtacccatttaactccagtcagatttccaccgacagcatgtccagttaagcctgctaatcttgtccgtttgaaggcaactagagctctgattcgtgatcctcaagaaagtaaccgtaagttccaaaagttcccaccttctgaatggactaatcgcttcgactctgtctcggtagatgcatcggaaatggatgcgcttaggaaagagatcgataagattataccgaacgtgaagaaggaactcatgtcttcccaaggcattgaatcgacgaagaaaaaaatccttatggtatatttgctggttagccttggtcttgcttatcacttcgaagatgagattgaagagtgtctgaaagagggtttcgaaacaatagaagagatgatggctggtgaagataatttgtatactatttcaatcatctttttggttttaaggacatacggtcaccatatgtcatccgacatatttcagaaattcaaaggaaacgatggaaattttaaaggatgcattagtggggacgctaagggtttgttggccttgtatgaagccgcgcaattgagaacgactacagagtatataatggaagaagcactgagcttcacatcgagcaatttggagttgttagctgcagatgggaggtgcccacctcatctctcaaaacatatacgaaatgctctaggactatctcagcataaacagatggaggtgttagtagctgtggaatatatctcattctatgaacaagaaaaagatcacgacaaaatactgctaaaatttgcgaagctcaatttcaagttaatgcagctccattaccttgaagagctcaaggtcgttacaaaatggtacaaggaacacgattttgcatctaacttgccaccttacttcaaatacgtaatcgtggagaatcatttctttgcaataacgatgtacttcgagccaaaattctcacaaaagcggattatgctggctaagtactttacggttttagtacttctagatgacacttgtgatagatacgcatctctttctgaggccgaaagcctcaccaatagtctggagaggtgggctcctgatgatgctatggataaacagccacattatttgaaattcgtgtttaagtttataatgggttgcttcgaagagtttgaaagagaattggcgtcagaaggaagatcttactctgtgaaagccacactagaagagtttaagacaattgtgaaagccaactttgattttgcaaaattggcacacacgggtcacgtgcctagttttaaggagtacatggaagttggtgaggtggaggttggggtatgtgcgactttggcaggcaatctgatgtgtatcggacatatcggtgatgagggagtttatgagtggctcaaatccagaccaaaatttctcaaagcagcctctacatatgggcgtctgatgaatgatatagccggatttgaggatgacatgaaaagagaatatgtcattacgggagtcaacacttatatgaagcaatatggtctaaccaaaatggaagctatcagagagcttcaaaacttagttgaatacaaccatacgataatgaacgaagagtttttgaagacaactgatttaccacgccaaattcggaaacaagtcatcaacgttgcacgctctctcaacgtctcctatactgaaggtgaaggatttacccataccaaaggaaaagtcgatgagtatatcacttctttgtttattaccccgattcgtatttga

SEQ ID NO: 542 - DNA, 1699 bp, Arabidopsis thaliana
  terpene synthase/cyclase family protein
accaacaccacatctctctctatctatggaagcattaggaaactttgattacgaaagctacaccaattttacaaaattgccatcctcccaatggggtgatcagttcctcaagttttccattgctgattcggattttgatgtccttgaaagagagattgaagtactaaagcctaaagtaagagagaacatattcgtgtcgtcttccacagacaaagacgcgatgaaaaagacaattctttctattcattttctggacagtcttggtctctcttatcattttgagaaggaaatcgaagagagcctaaaacatgctttcgagaagatagaagatttgatcgctgatgaaaataaattgcacacaatctccaccatcttccgagttttcaggacatacggttactacatgtcttcggatgttttcaagatattcaaaggagacgatggtaaattcaaggaaagtttaatagaagatgtcaagggtatgctaagcttctacgaagcagtgcactttgggacaacgacagatcatatattggatgaagctttaagcttcacattgaaccacttggagtcactagctacaggtcgtagagcgagcccaccacatatttcaaagcttatacaaaatgctcttcacatacctcagcaccgaaacatccaagcgttggttgcaagggagtatatctcgttctatgaacacgaagaggaccacgacgaaacacttctcaagctagctaagctcaatttcaagttcttgcagcttcattacttccaagaattaaaaaccatcacaatgtggtggacgaaattagaccatacatcaaaccttccaccaaacttcagagagagaactgtagagacatggtttgcagcattgatgatgtacttcgagccacaattttcacttgggagaattatgtcggctaagttatacttagtaataacatttctagacgacgcttgcgatacttatggttcaatttctgaagttgaaagcctggccgattgtttggaaagatgggatccagattacatggaaaatcttcaaggtcacatgaagactgccttcaaatttgtgatgtatctttttaaagagtatgaagaaatactaaggtcacaaggaagatcctttgtgttggagaaaatgatagaagagttcaagattattgctaggaaaaacctcgaacttgtcaaatgggcacgtggaggtcatgttcctagctttgatgagtatatagagtctggtggagccgagattggtacatatgcaaccatagcatgttccatcatgggacttggagagattggtaagaaggaagcttttgagtggctaatatctagaccaaagctcgttcggattttaggtgcaaagacccgtctcatggatgacatagccgactttgaggaggacatggaaaaaggttacactgcaaatgcactcaactattacatgaacgaacacggagttacaaaagaagaagccagtagagaacttgaaaagatgaatggagatatgaacaagatcgtaaacgaagaatgcttgaagataactaccatgccacgccgaattcttatgcaatccgtcaattatgcacgttcattggatgttctctataccgcggatgatgtttacaaccaccgcgaaggaaaactcaaagagtatatgaggcttttgctcgtagatcctatacttctttag

SEQ ID NO: 543 - DNA, 1644 bp, Arabidopsis thaliana; identical to SEQ ID NO: 528
  beta-caryophyllene/alpha-humulene synthase

SEQ ID NO: 544 - DNA, 1818 bp, Arabidopsis thaliana
  terpene synthase
atggaagccacatcagtttttaggccaaaacttggatctcagttttctcttccttctacgaccaatttatttccgttaagaaaactctatggctttcctctgacgtcatttcccggtaagcctataaagcgtattcgtttgaaggcctctaatactctgacatttgatgataaagaacgtactcgtaagttcaagaaattaccactttctgaatggactcactacttccactcgattccccttgatatctcggaaatggatgcacttaaagaagagatcgatgaactaaagccgaaagttaaaaacacattcatgtcttcccaaggcagtgactctacaaagacgaaaatccttatgatatatttgtttgtgagccttggccttgcatatcacttcgaggaagagatatatgagactctaaaagagggtttcgaaaatatagagaagatcatggccggtgaagaagatttgtacacagtttcgatcatcttttgggttttcagaagatatggtcactacatatcttcagatgtattccaaagattcaaagggagcaatggaagttttaaagagtctcttatcggagacgccaagggtatgttgagcttgtatgaagctgcacatttggcgacaacaaaagattacatattggacgaagcattgatctttacatcgagccacctggagacattagttgcaactggaacgtgcccacctcatctcttagcgcgtatacgaaatgctcttagcatctgtcagcattggaactttgaggtattagtcccactggatttcataccattctatgaacaagaaaaagaccatgacgagatgctactcaaatttgctaagctcagtttcaagtatctgaagctcatataccttcaggatctcaaaatccttacaaaatggtacaagaagctagattttccatctaagtttccaccttacttcaaagacagatgcgtcgaaaattatttctttgtgttaccggtgttcttcgaaccacaactctcaagtgcaaggatgttgttgactaagggcttcatccttctggggattcaggatgacacattcgacagatatgcatctatttctgaggccgaaagcctcggcaacagcttgaaaaggtgggctccagatcattccatggacaaacaacctgaatatttgaaatccgtattgaaggttatattagatactttccaagagtttgaaaaagaacttagccccgaaggaagatcttacagtgtgaaatacacaattgaagagttccaggcatcttcgaaagctaacgttgagttggcaaaatgggcacaagtgtctcacgtacctagctttgagaaatacatggaagttggacagatggaaatcaccgcatgtgtgaccgttgcatatattttaatgtctatgggaaagacggatagtaaggaagcttttgagtggctaaaatccagaccaaaactcgtccaatctttatgtactaaaggtcgtcttatgaatgatatagccggttttgaggatgacatgagtagaggatatgtcgtgaatgctgtcaattgttatatgaagcaatacggagttactgaaaaggaagcttttaaggagattcgtaaaatggttgtaaatacacataagacattaaatgaggagttcttgacaaccacttgcgtgccacattatgttcttagggaaaccatggattttgcacgcatgatcatcgtcacctacaatggatatgaaggatttacccgtcctgatgaaggaataatcaaggagtatatgacttcgttattcgtcgatcagatcgatctttga

SEQ ID NO: 545 - DNA, 1812 bp, Arabidopsis thaliana
  terpene synthase
atggaagcatcaaaatgttttggtccaagaactctccctatcattcacaacgtccctctctgtctgaagaccaacttctctctctttcctcgctgtttgcttcaaagccaatctctttcctccaagaaatccacaaaacacgacttgttccgtgttaaggctgagactagtggcgatcttgagaatactcgtccattgacgtactattctccatctctttggggagatcacttcctctctgttcccatcgatgaatccaaatttgaggcacttgagaaagaaattgaatcggtgttcaagcctaaagtgagagacatgctcatgtctcctcacagcagcgacaaggagaggattcgtctcatccatttgcttatcagcctcggtatcgcttattactatgagaatgaaatcgaggagattttacacaaggcttacgggaagttggcctgcttaatttcggacgaggatgatttggaaacaatagcaatcatgtttgaggttttcagactatatggacacaagatgccttgcgatgtgttcgagagattcaaaagcgaagatgggaagtttaaggaaagtttagttggggatgttagagggctgctacagatgtacgaagccgcgcatctaggagcaccatctgaagatataatggatgaagccttgagttttgcgcggtatcacttggaatcgttggtaagccacgaaacaagctccaatctctttaatcatgtacaaaacgaattgtatagagctcgatatcatagcatagagatactagtagcacggcagtacatctctttctatgaacaagaagaagaccatgatgagacgctcctcaggttttcaaagctcaacttcaatttttgccagatgcattacgtcaaagacctcaaaattgtcaccagatggtggaaggagctaggtatcgcatctaagctaccctactctataagggaacgaaatgtggaggtctatcttgggagcttgggaatgtttttcgagccacggtattcacttgccagaattttttcggccaagcttacaatgatcttgactgttgttgatgatacatgcgattcatatgccactcttcctgaagttaagagtcttcatgatgcttttcatagatgggatctgcgtgccatggaagaactaccgaggtatatgagaatcatctaccaaagtgtgttcgagactgtggaagatattgatcgagaaatgatagctcgaggaaaacatggtcggttgcaactaaccatagatgagattaagagtctaatgatatggtatcttgggatagcaaaatgggcacgctcagatcaagtgccaagctttgaggattacatggagattgggaccccctcgtctgcattggatgacttagcatcatacggctttatagcaatggacgattgtgatcagaagaaattgaaggagtggttttactccaaacctaaaatctttcatgccttgaatgctctgtttcgtatcagaaatgacattgtcacgttcgagcaagagatgagcagaggagaggtggcaaatggtgtcaattgttacatgaagcaacatggtgtcaccaaagaagcagcggttgaagaactgaggaagatggaaagagagaattataagataatgattgaggagttcatgacgtccaaagctatgccacgccagattctggtgcgacccgtcaacattgcgcgtgtgatggatttgtattacaaagaagccgatggatttgggcatcctgatcaaaagctcttacaacttattgcgtctttgttcctccatccaatacctctttga

SEQ ID NO: 546 - DNA, 1818 bp, Arabidopsis thaliana
  terpene synthase
atggacgcaacaagaacgttttttggtcttcctaacgttcacaacgttcctctctgtctcacgtccaacctctctctctttcctcagcgtttgcttcaaaagcacactcttcccctgaaaccggtaaagagacaccacttggtatgtgtaaggtctacaaagagtagtgatgatcttgagggtagtcgtccttcaacgtacttttctccctctctttggggagatcacttcctctctgtttccctcgaccgcggtgaatttgatgaactagaaagagagattgaaactatgaagccactggtgaaagacatgctcatgtcttctcaaagcagcgacaaggagaagattcgtctcatccatttgctcgttagcctcgggagctcttatcattttgataaggagattcaagatatccttaaacacagtttcacaaagttggatgacataatagttggggaagatgatttggaaacaatctccatcatgtttgaggtctttagactatacggtcacaagatgtcttgtgatgcctttgatagattcagaggtgaagatgggaggttcaaggagagtctagccaaagatgttagaggaatgctacagttgttcgaagtcgcgcatctaggaacaccctctgaagatataatggacgaagcatcgagtttcgcccagaatcacttggagtcttggatagctggtaacgtatccggtgcaactccccatctcttgaagcatatacaaaactcattatacatacctcgatactgtaacatagaagtactagtggcaagagaatatatatcttactacgaacaagaagaaggttacgacgagatcctgctaaagtttgcaaagcttaacttcaacctttgccagtttcgttacatccaagaactcaaaactctgaccaaatggtggaaggacctagatcttgcatctaagttaccttacatcagggatagacttgtagagagccatctcgggggtttgggaccgtacttcgagccacactattctcttgggaggatcatagtggctaaaatcatcatgaccatggttgttgtggatgacacttatgatgcacatgcaactgtacccgaagttgcggtgcttacggaatgtttgcagaggttgaatattggtgccgatgataaactaccagactatttgagaatcgtcctcgaaagtgtgtttgaagttatgggagagattgaacaagaaatgagaccgaaaggaagatcatacggcgtgaaacaagtgttggaaaggttcaagaacgtagcaaaggcggacaaacagttaacagagtgggcacgaacgggccacgtaccatcctttgatgagtacatgaaagttgggttggtgacagctgggatggatggttatgcaggatattgctttataggaatggaagatatcagtgagaaggaagcttttgagtggctgagttccaatcccctaatcatccaagcgctaaatgtaatgttccgtttagcaaatgacgtaggaacctacgagaccgagataaacagaggagaggtggctaatgggctcaactgttacatgaaacaatatggagtcaccaaagaagaagcatcccaagagttgcgtaaaatatacagcaacaacaaaaaagtggttatggaggagttcatgaactcacatgaccatgtgccacgccaggttctgctgcgatgcctcaactttgcacgcctcttcgatgtgatgtacacggagggtgatggatacagtgaacccaaaggcaaaatcgaacactttatgacctccttgtacgtccacccaatacccctttcataa

SEQ ID NO: 547 - DNA, 1863 bp, Artemisia annua
  (-)-beta-pinene synthase
atggcttcaatgtgcacattttcttctccatttctcttatgtaatagttccataagtagaacaaatattgttgcatgtaacaagcaaacatctacactacaagcccaagttaaaaatgttgctacaattgaaaccaccaacagaagatcagctaattatgccccttcattatggtcctatgattttgtccagtcgctttctagcaaatacaaaggagataactatatggcaagatcacgagctctaaaaggagtagtgaggaccatgattttagaagcgaatggaattgaaaatccattgagtttacttaatttggtcgatgatttgcaaagacttggaatatcatatcattttttggatgaaataagcaatgttttggagaaaatatacttaaatttctacaaaagtcctgaaaagtggactaatatggatttaaatcttagatcccttggttttagactcttgagacaacatggatatcatattcctcaagagatattcaaggactttatagacgtgaatggaaatttcaagggagatatcatcagcatgctaaatttgtatgaagcttcttatcattcagtagaggaggaaagtatattggatgatgctagagagttcacaacaaaatatttgaaagaaactttagagaatattgaagatcaaaatatagcgttgttcataagtcatgcattggtttttccacttcattggatggttccacgggtggaaacaagttggtttattgaagtttatccgaaaaaagttggcatgaatcccacggtgcttgagtttgcgaaactggacttcaacatactgcaggcagttcaccaagaagatatgaaaaaagcatcaagatggtggaaagaaacatgctgggagaagtttggctttgctcgtgatcgtttggtggagaacttcatgtggactgttgccgaaaattacttgcctcattttcaaacaggaaggggagttctcacaaaggttaacgccatgataaccactatcgacgatgtttatgatgtgtatggtactttgcctgaactcgaactatttaccaacattgtaaacagttgggatatcaatgcgattgatgaacttccggattatttgaaaatatgcttccttgcgtgctacaatgctaccaatgaattatcatataacacattgacaaacaaaggattcttcgtacatccttaccttaaaaaggcgtggcaggatttatgcaactcttacataattgaagctaaatggttcaatgatggatacacaccaaccttcaacgagttcattgaaaatgcatacatgtcaataggaattgctccgatcatcaggcatgcctatttgttaacattaactagtgttaccgaagaagcattgcaacacatagaaagagctgaaagtatgattcgcaatgcatgcctaattgtgcgactcactaatgatatgggcacatcatctgatgagcttgaaagaggtgatattccaaaatcaatccagtgctatatgcacgaaagtggtgctactgaaatggaagcacgagcgtatataaaacagttcatcgtcgagacatggaagaaactgaacaaagaacggcaagaaattggttctgaatttccgcaagagttcgttgattgtgttataaaccttcctagaatgggtcatttcatgtataccgatggagacaaacatggtaaacccgacatgttcaagccgtatgtattttcattgtttgttaatccaatctagggggtaccctaaaattttcaacttgtaacttaataaacctatctcgttatatgttgtcaagattattcttattggctcattaatcttgttataatgaaaaaaaaaaaaaaaaaa

SEQ ID NO: 548 - DNA, 1769 bp, Artemisia annua
  (3R)-linalool synthase
ggtaatgcttacatgcgaatatattcaacaaaaaccacaagaataactgccaatgcaactgtcaatgcagctgacacccacgtaaggcgatcagcaaattacaaaccatcatcatggtcatttgatcatattcagtcactctctagtaaatacacgggagatgattacgtggcaagagcaaatactttgaaggacgcagtgaagacgatgatacgaaaatcaggaaattcgttgagaactctggagctagttgatgagttgcaaagattaggaatctcgtatctttttgaggaggaaataagtaatctcttggaaacgatttactacaattactataaatttcctgaaaattggaataagatcaatttgaaccttaaggctcttggctttcgattactgagacaacatggttatcatgttcctcaagagatatttctcaactttaaggacaagaatcaaaatcttaattcatatttactcaacgatgttgtggaaatgctcaacctgtatgaggcatcttatcattcgttcgaggatgaaagcatattggacgacgctagagacatcacaaccaaatatctcaaagaaagcttggagaagattgacgggagtatcttttcatcagtaactcatgctttggagcaaccgctgcattggagggtaccgagagttgaggcgaagtggtttattgaactatatgagaaaaagaatggcatgagtcccacattagtcgagcttgcgaaattggatttcgatatggtccaggctatccatcttgaggatctaaaacacgcatcaaggtggtggagagatacaagttgggataccaagttaacctttgcaagggacttgatagtggagaatttcttgtggacaattggtttcagttacttaccaaactttagtcgtgggaggagaacaataactaaggtggccgttatgattactactctcgatgatgtctatgatgtgtttggtactttgggcgaactagaacaattcactgatgttataaacagatgggatataaaggcgattgaacaactcccagattatatgaagatatgtttcttaggactttacaagtcgataaatgatatcacgcatgaaactttggcaaacaaaggattcctcattcttccatatttaaagaaagcatgggcagatctatgtaaggcgtacctagtagaagctcaatggtaccaccgtggacatataccaacactgaacgagtacttggacaatgcttgtgtatcgatatcaggacctgtagcacttatgcatgtccactttttaacatcagttagttcaatcgaagaaatccatcaatgcatacaaagaactgagaatatagttcactatgtatcacttatcttccgacttgctgatgacttggggacatcattaggtgaaatggaaagaggtgatactctaaaatcaatccagttgcacatgcatgagaccggtgctactgaaccagaagctagaagttatataaaattgttaatcaacaaaacatggaagaaacttaacaaagaacgagcaactgttaactccgaatcttcacaggagtttattgattatgcaacaaaccttgttagaatggctcaattcatgtacggtgaaggagacgaggattttggtctagatgtgattaaatctcatgtattatcattgttgtttactccaatccaagggatataaatatgtaacacgatggtatatatacgtgaataagaagctaaggagatcttagtattcttgtcttc

SEQ ID NO: 549 - DNA, 1725 bp, Artemisia annua
  (E)-beta-farnesene synthase
atgtcgactcttcctatttctagtgtttcattctcttcatctacgtcacctttggttgttgacgataaagttagcacgaaaccagatgttatccgccataccatgaatttcaatgctagcatatggggagatcaatttcttacatatgatgagccagaagatttggttatgaagaaacaacttgttgaagagctcaaagaggaagtcaagaaagagctaataacgatcaaaggttcaaatgaaccgatgcagcatgtcaagttgatagaacttattgatgcagtccaacggcttggcatagcctatcattttgaagaggagattgaagaagccttgcaacatatccatgttacatatggcgagcagtgggtcgataaagaaaacctacaaagcatttctctttggttccgactcctacgacaacaaggcttcaacgtctcatcaggagtattcaaggactttatggacgagaagggaaaatttaaggaatccttatgtaatgatgctcagggaattcttgctctgtatgaagcggcatttatgagggtggaagatgaaacaatactagataatgcgctcgagttcactaaagttcaccttgacatcatagccaaggatccttcttgtgactcttccctaagaacccaaatacaccaagcgttaaagcagccacttaggagaaggctggcaaggattgaggcgttgcattacatgcctatctaccaacaagaaacatcccacgatgaggtcttactgaagcttgcaaaattagattttagcgtgcttcagtcgatgcacaaaaaggaacttagccacatttgcaaatggtggaaggatttggacctccaaaataagcttccttatgttcgagacagggtggtggaaggctatttttggatactatccatctattacgagcctcaacatgctcgaacaagaatgttcctaatgaaaacatgcatgtggttagtcgttttagatgatacatttgataattatggtacttatgaagaactcgaaatctttacacaagctgttgaaagatggtcaataagctgcctggatatgcttccagaatacatgaaactaatatatcaagagcttgtgaatcttcacgtggaaatggaggaatcacttgaaaaggagggaaaaacatatcaaattcactatgtcaaggagatggcaaaagagttggttcgcaattacttggtagaagccagatggctaaaagaggggtacatgccaactcttgaggagtacatgtctgtgtcaatggtgactggtacctatggcttgatgatagcgagatcttatgtcggcaggggtgatatcgtcaccgaggatacctttaaatgggtgtcctcgtatcctcctattataaaagcttcatgtgtgattgtaagacttatggatgatattgtcagccacaaggaggaacaagagagaggccatgttgcttcaagcatcgaatgctattctaaggaaagtggtgcatcagaggaggaagcgtgtgaatatatctcaagaaaagttgaagatgcatggaaagttataaaccgagagtcgctcaggcctacagctgtcccatttcctctacttatgcctgcaatcaaccttgcacgtatgtgtgaagtcctatatagcgtcaacgatggcttcactcatgctgagggagacatgaaaagttacatgaaatcgttcttcgttcaccctatggttgtctaa

SEQ ID NO: 550 - DNA, 1985 bp, Artemisia annua
  8-epi-cedrol synthase
caggaattcgattccgtactaattcgcatcttttatcaagcatgtctcttatagtagaggatgtcatacgccccaatgcaaattttccttctgaaatttggggagatcagtttcttgcctatgaccaggatgagcaagagggagttgaacaagtaatcaaagatttgaaagaagaagtgaagagcgaactattgacagctctaaattctccgactcagcatacggagttgttgaaatttattgacgcaatcgaacgccttggtattgcgtattattttgaagaggagatcaaccaagtattccaacacatgtatactgcatatggtgataagtggacaggtggtaatacttccctttggtttcgactcatgcgacaacatggatttttcgtttcaagcgatatttttagtacctacaaagacaaagagggacgttttaaggagtctttagaaaaggacgttcacgggttacttgagttgtatgaggcggcatatatgtttgtgcctggggaagggatactagatgatgctcttgtttttacaagaacttgtcttgatgaaatagcgaaaaatcctagtctaagtaactctgctgtttcttcccaaatacgtgaagctctaacgcaacctttacataaaagattaccgagactagaggcgttgcgctacatacctttctaccaacaacaagcttctcacagtgagacattgttaaaactggccaaattagggttcaaccaacttcaatcacttcacaagaaagagcttagcataatttccaagtggtggaaaagtttcgatgttgcaaacaatctaccgtatgcaagaaatagacccgttgaatgctacttttgggcattagcagtgtacttcgagcctcaatattctgaatcaagagtcttcttatcaagatttttttcaatacaaacatttcttgatgacacttatgatgcctacggtacttacgaagaacttgaacaatttactgaagcaattcaaaggtggtcaataacatgcttggacggtcttcctgaaagcatgaagcttatattccaaatgctagtgaagatttttgaagaaatagaggaaatattgtcgaaggatggaaaacagcatcatgtcaactacatcaaagaaacactgaaagaggctgtccaaagctacatgacagaagcaagatgggcaaaagaagagtatataccaacgattgaggagcacacaaaagtgtcatatattagcatcggctataaacttgcgctagtagcaggttttgcttgcatgggtgatgtaattgcagatgactcatttgaatgggttttcaccaatcctcctcttgtcaatgcttgttgtctactttgtagaaccatggatgatcttggttcccataagggcgagcaagatagaaagcatgttgcctccactattgaatgctacatgaagcaatttgatgctagcgagcaacaagcctacgaatcactcaacaagaaagttgaagatgcatggaaagaaataaatagagagttcatgatcacgtgtaaggatgttaatattcatgtagctatgagggtccttaatttttcacgttcggtggatgtcctttataagaataaggatcactttacacatgttggagtagaggtgataaatcatatcaaatctcttttcgttgatgccatcattacatgaattccagttcttcgtgagctaccatgtcttacagatttggaatttgaataagggtatgttactatgttttattgtggttacattgaataacatgccaagttatttggcatattatggttcagcggtaccatcgctgtttatttctgcaagttgtcttataaattgtcatgtaatattaatgcgtgtgaggttttaatatttaacgacgatgatgtttccatcttcgagtaaaaaaaaaaaaaaaaaaaaaaaaaaaaaaaaaaaaaaaaaaaaaaaaaaaaaaaaaaaaaaaaaaaaaaa

SEQ ID NO: 551 - DNA, 1946 bp, Artemisia annua
  8-epi-cedrol synthase
tcagcgtatactaattcgcatcttttatcaagcatgtctcttatagtagaggatgtcatacgccccaatgcaaattttccttctgaaatttggggagatcagtttcttgcctatgaccaggatgagcaagagggagttgaacaagtaatcaaagatttgaaagaagaagtgaagagcgaactattgacagctctaaattctccgactcagcatacggagttgttgaaatttattgacgcaatcgaacgccttggtattgcgtattattttgaagaggagatcaaccaagtattccaacacatgtatactgcatatggtgataagtggacaggtggtaatacttccctttggtttcgactcatgcgacaacatggatttttcgtttcaagcgatatttttagtacctacaaagacaaagagggacgttttaaggagtctttagaaaaggacgttcacgggttacttgagttgtatgaggcggcatatatgtttgtgcctggggaagggatactagatgatgctcttgtttttacaagaacttgtcttgatgaaatagcgaaaaatcctagtctaagtaactctgctgtttcttcccaaatacgtgaagctctaacgcaacctttacataaaagattaccgagactagaggcgttgcgctacatacctttctaccaacaacaagcttctcacagtgagacattgttaaaactggccaaattagggttcaaccaacttcaatcacttcacaagaaagagcttagcataatttccaagtggtggaaaagtttcgatgttgcaaacaatctaccgtatgcaagaaatagacccgttgaatgctacttttgggcattagcagtgtacttcgagcctcaatattctgaatcaagagtcttcttatcaagatttttttcaatacaaacatttcttgatgacacttatgatgcctacggtacttacgaagaacttgaacaatttactgaagcaattcaaaggtggtcaataacatgcttggacggtcttcctgaaagcatgaagcttatattccaaatgctagtgaagatttttgaagaaatagaggaaatattgtcgaaggatggaaaacagcatcatgtcaactacatcaaagaaacactgaaagaggctgtccaaagctacatgacagaagcaagatgggcaaaagaagagtatataccaacgattgaggagcacacaaaagtgtcatatattagcatcggctataaacttgcgctagtagcaggttttgcttgcatgggtgatgtaattgcagatgactcatttgaatgggttttcaccaatcctcctcttgtcaatgcttgttgtctactttgtagaaccatggatgatcttggttcccataagggcgagcaagatagaaagcatgttgcctccactattgaatgctacatgaagcaatttgatgctagcgagcaacaagcctacgaatcactcaacaagaaagttgaagatgcatggaaagaaataaatagagagttcatgatcacgtgtaaggatgttaatattcatgtagctatgagggtccttaatttttcacgttcggtggatgtcctttataagaataaggatcactttacacatgttggagtagaggtgataaatcatatcaaatctcttttcgttgatgccatcattacatgaattccagttcttcgtgagctaccatgtcttacagatttggaatttgaataagggtatgttactatgttttattgtggttacattgaataacatgccaagttatttggcatattatggttcagcggtaccatcgctgtttatttctgcaagttgtcttataaattgtcatgtaatattaatgcgtgtgaggtttaatatttaacgacgatgatgtttccatcttcgagtaataatatgttatttagtttcaataaaaaaaaaaaaaaaaa

SEQ ID NO: 552 - DNA, 2067 bp, Artemisia annua
  amorpha-4,11-diene synthase
gttttgaaaatcatgtcacttacagaagaaaaacctattcgccccattgccaactttcctccaagcatttggggagatcagtttctcatctatgaaaagcaagtagagcaaggggtggaacagatagtgaatgatttaaaaaaagaagtgcggcaactactaaaagaagctttggatattcctatgaaacatgccaatttgttgaagctgattgatgaaatccaacgccttggaataccgtatcactttgaacaggagattgatcatgcattgcaatgtatttatgaaacatatggtgataactgggatggtgaccgctcttccttatggttccgtcttatgcgaaagcaaggatattatgttacatgtgatgttttcaataactataaagacaaagatggagcgttcaagcaatcgttagctaatgatgttgaaggtttgcttgagttgtacgaagcaacttctatgagggtacctggggagattatgttagaagatgctcttggttttacacgatctcgtcttagcattatgacaaaagatgctttttctacaaaccccgctctttttaccgaaatacaacgggcactaaagcaacccctttggaaaaggttgccaagaatagaggcggcgcagtacattcctttctatcaacaacaagattctcataacaagactttacttaaacttgctaagttagagttcaatttgcttcagtcattgcacaaggaagagctcagccatgtgtgcaagtggtggaaagctttcgatatcaagaagaacgcaccttgtttaagagatagaattgttgaatgctacttttggggactaggttcaggctttgagccacagtattcccgggctagagttttcttcacaaaagctgttgctgttataactcttatagatgacacttatgatgcgtatggtacttatgaagaacttaagatctttactgaagctgttgaaaggtggtcaattacatgcttagacacacttccagaatacatgaaaccgatatacaaattattcatggatacatacacagaaatggaagaatttcttgcaaaggagggaagaacagatctatttaactgcggcaaagaatttgtgaaagagtttgttagaaacctgatggttgaagcaaaatgggcaaatgagggacacataccaaccactgaagagcatgatccagttgtaatcattactggcggtgctaacctgcttacaacaacttgttatcttggcatgagtgatatattcacaaaagagtctgtcgaatgggctgtctctgcacctcctctttttagatactcaggtatacttggtcgacgcctaaatgatctcatgacccacaaggccgagcaagaaagaaaacatagttcatcgagccttgaaagttatatgaaggaatacaatgtcaatgaggagtatgcccaaaccttgatttacaaggaagtagaagatgtgtggaaagatataaaccgagagtacctcacaactaaaaacattccaaggccgttattgatggctgtgatctatttgtgccagtttcttgaagttcaatatgcaggaaaggataacttcacacgtatgggagacgaatacaaacatctcataaagtctctactcgtttatcctatgagtatatgactaccaatccttcgtgcatagcctatcaattatattgaaagggttaactatgcatgtctctatgaagagaatttctcaagctatttggtgtttcttgctggcaataataaatcagacgcataaaattgtattgaactatatgccgatagctatttaaagttattatacaactaaaatattcataaatggtattatacttttactttgtacaaaagcaaaagtacactactgttatgtaacattttagttctatgatactttagttacgaatcggcttatatacattgatacacttttatgcagaaaaccctactaaataaaaagtcgatatcttgtactacacatatcgcacgaatttccgtttgccgtttgtatttttgatatgttatttaatgaatatgtttcatgtggttg

SEQ ID NO: 553 - DNA, 1902 bp, Artemisia annua
  (E)-beta-caryophyllene synthase
cataatccaaacttctcatagacatgtctgttaaagaagagaaagtaattcggcccattgtccactttcctcctagcgtttgggcagaccagtttctcatcttcgatgacaagcaagcagagcaagccaatgtagaacaagtagtcaacgagttaagagaagatgtgagaaaagatttagtgtcatctttagatgttcaaacggagcacacaaatttgctaaaacttattgatgctatccaacgtcttggtatagcgtatcattttgaagaggagattgagcaagccttacaacatatttatgatacatatggtgatgactggaaaggcagaagcccttccctttggtttcgaatccttcggcaacaaggtttttatgtttcttgtgatatttttaaaaactataaaaaagaggatggttcatttaaggaatccctcaccaacgatgtagaaggcttgcttgagctgtatgaggcgacatatttgagagtgcaaggcgaaggggttctagatgatgctcttgttttcacaaggacttgtcttgagaaaatagcaaaggatcttgttcacaccaacccaacactatctacctacatacaagaagcactaaaacagccgttacataaaaggttgacaagactagaggcattgcgttacattcctatgtacgaacaacaagcatctcataatgagtctttactcaaacttgcgaagctaggtttcaacttacttcaatcattgcatagaaaggagcttagcgaagtttccaggtggtggaaaggtcttgatgtcccaaacaatctaccttatgcaagagatagaatggttgaatgttatttttgggcactaggtgtctattttgagccaaaatattctcaagctaggatctttttagcaaaagtaatttcgctagcaactgttcttgacgacacttatgatgcttatggaacctatgaagaacttaagatctttactgaagcaattcaaaggtggtcgattacatgcatagatatgcttccagaatacctgaaactattataccaaggagtcttggatatatacatagaaatggaagaaataatgggaaaagagggaaaagcacatcatcttagctatgctaaagaatctatgaaagagtttattagaagctatatgatggaagcaaaatgggcaaatgaggggtatgtaccaacagcagaggagcatatgtcagttgcgtttgtaagcagcgggtatagcatgcttgcaacaacatgttttgttggcatgggtgatatcgttacagatgaagcattcaaatgggctctgacaaaacctcctatcatcaaagcttcatgtgcaattgctagactcatggatgatattcactctcaaaaggaggagaaagaaagaatacatgttgcatctagtgttgaaagttacatgaagcaatatgatgtgacagaggagcatgtccttaaagtatttaacaagaaaatcgaggatgcgtggaaagatataacccgagaatcccttgtgcgtaaagatattccgatgcctctgatgatgcgagtgattaacttggcacaggtgatggatgttttatataaacataaagacggtttcactaatgtgggagaagaactcaaggatcatattaaatctttgctcgttcatcctatacctatataagttccgaaacttcatctcgtttttagcctccgatacactcaacaactcaactttctctcatcttcaaatggttggttgtggcaaatcttaagtccttgggtgattgaaatcttcaaatgcgtgtttgttactacatgcatgtgatttttttccccctcttctgtgtggcatttgtatttggatgatttaataataaataaaggtgtgtttgtgttaaaaaaaaaaaaaaaaa

SEQ ID NO: 554 - DNA, 1689 bp, Artemisia annua
  germacrene A synthase
atggcagcggttcaagctaatgttactggtatcaaagcaaacaccaaaacctccgcagagccagtgcggccgttggccaactttcctccttcagtatggggtgatcgcttcctttcattctctcttgacagatcggaattggagcgatatgccatagctatggagaagccgaaggaggacttgagaaagttgatcgtggatccgaccatggattctaatgagaaactaggtttgatttattctgtgcatcgtctcggtttgacatatatgttcttgcaagagatcgaaagccagcttgacaagcttttcaacaagtttagcttgcaagattatgaagaagttgatctgtacactatttcgattaattttcaagtttttcgacacgttggttacaaactaccttgtgatgtctttaacaaattcaaggacgttagctcgggtactttcaaggcatccattacgagtgatgtgggggtagttgggctatatgaatctgcacagttgagaataagaggagaaaagatacttgatgaagcctcagttttcactgaagctaaactcaagagtgtagtgaacactcttgaaggtgatcttgcacaacaagtgacacaatctttaaggagaccattccatcaagggatgccattgggtattaggcaaggctctatttctctaactatgaaaaagaatgttccacttatgactcattgcttaaagcttgcaaagcttcactttaagtatttggagctacaacaaaaagaagaactgcgaattgtatcaaagtggtggaaggatatgaggtttcacgaaactactccttatataagggatagagtaccagagatttacttatggatattgggattatactttgagcctcgttactccttggcaagaatcatcgcaacaaaaataacgttgtttctcgtggttttagatgacacatatgatgcttatgctaccattgaagagattcgccttctaacagatgctataaacaagtgggatattagtgctatggagcaaattccagagtatattagaccattttacaaaattcttttagatgaatatgctggaaattggagaagaaaatggctgaagaagggagagcaaatactgttattgcttcaaaagaagcgttccaagacattagctagaggttaccttgaagaggctgaatggacaaacagtggatatgtggcatcatttccggagtatatgaagaatggattaatcacttctgcttataatgtcatttcaaaatcggctttagttggtatgggtgagattgttagtgaagatgctttggcttggtatgaaagtcatccaaagactttgcaggcttctgagttgatttcaagacttcaagatgatgtcatgacttaccagtttgaacgtgaaagaggtcaatctgccactggcgttgatgcgtatattaagacttatggtgtctcagaaaaggaagctattgacgcgctcaagatcatgattgagaatgcatggaaagatataaacgagggatgtctaaagccaagacaagtctcaatggatttgcttgctccaattcttaaccttgcaagaatgatagatgtggtatacaggtacgacgacgggttcacttttccaaggaaagactctgaaagagtatatcaatccttctgtttgtgggttctctaccccgtgtaa

SEQ ID NO: 555 - DNA, 1893 bp, Artemisia annua
  putative sesquiterpene cyclase
tcagcgtatactaattcgcatcttttatcaagcatgtctcttatagtagaggatgtcatacgccccaatgcaaattttccttctgaaatttggggagatcagtttcttgcctatgaccaggatgagcaagagggagttgaacaagtaatcaaagatttgaaagaagaagtgaagagcgaactattgacagctctaaattctccgactcagcatacggagttgttgaaatttattgacgcaatcgaacgccttggtattgcgtattattttgaagaggagatcaaccaagtattccaacacatgtatactgcatatggtgataagtggacaggtggtaatacttccctttggtttcgactcatgcgacaacatggatttttcgtttcaagcgatatttttagtacctacaaagacaaagagggacgttttaaggagtctttagaaaaggacgttcacgggttacttgagttgtatgaggcggcatatatgtttgtgcctggggaagggatactagatgatgctcttgttttcacaagaacttgtcttgatgaaatagcgaaaaatcctagtctaagtaactctgctatttcttcccaaatacgtgaagctctaacgcaacctttacataaaagattaccgagactagaggcgttgcgctacatacctttctaccaacaacaagcttctcacagtgagacattgttaaaactggccaaattagggttcaaccaacttcaatcacttcacaagaaagagcttagcataatttccaagtggtggaaaagtttcgatgttgcaaacaatctaccgtatgcaagaaatagacccgttgaatgctacttttgggcattagcagtgtacttcgagcctcaatattctgaatcaagagtcttcttatcaagatttttttcaatacaaacatttcttgatgacacttatgatgcctacggtacttacgaagaacttgaacaatttactgaagcaattcaaaggtggtcaataacatgcttggacggtcttcctgaaagcatgaagcttatattccaaatgctagtgaagatttttgaagaaatagaggaaatattgtcgaaggatggaaaacagcatcatgtcaactacatcaaagaaacactgaaagaggctgtccaaagctacatgacagaagcaagatgggcaaaagaagagtatataccaacgattgaggagcacacaaaagtgtcatatattagcatcggctataaacttgcgctagtagcaggttttgcttgcatgggtgatgtaattgcagatgactcatttgaatgggttttcaccaatcctcctcttgtcaatgcttgttgtctactttgtagaaccatggatgatcttggttcccataagggcgagcaagatagaaagcatgttgcctccactattgaatgctacatgaagcaatttgatgctagcgagcaacaagcctacgaatcactcaacaagaaagttgaagatgcatggaaagaaataaatagagagttcatgatcacgtgtaaggatgttaatattcatgtagctatgagggtccttaatttttcacgttcggtggatgtcctttataagaataaggatcactttacacatgttggagtagaggtgataaatcatatcaaatctcttttcgttgatgccatcattacatgaattccagttcttcgtgagctaccatgtcttacagatttggaatttgaataagggtatgttactatgttttattgtggttacattgaataacatgccaagttatttggcatattatggttcagcgttaccatcgctgtttatttctgcaagttgtctttttaattgtcatgtaatattaatgcgtgtgaggttttaatatttaacgacgatgatgtt

SEQ ID NO: 556 - DNA, 1843 bp, Artemisia annua
  putative sesquiterpene cyclase
gtggtatcaacgcagagtggccattatggccggggaatatcaaactcgcaagattttgagatgtcgactcttcctatttctagtgtttctttctcttcatctacgtcacctttggttgttgatgataaagttagcacgaaaccagatgttatccgccataccatgaatttcaatgctagcatatggggagatcaatttcttacatatgatgagccagaagatttggttatgaagaaacaacttgttgaagagctgaaagaggaagtcaaaaaagagctaataacgatcaaaggttcaaatgaaccgatgcagcatgtcaagttgatagaacttattgatgcagtccaacggcttggcatagcctatcattttgaagaggagattgaagaagccttgcaacatatccatgttacatatggcgagcagtgggtcgataaagaaaacctacaaagcatttctctttggttccgactcctacgacaacaaggcttcaacgtctcatcaggagtattcaaagactttatggacgagaagggaaaatttaaggaatccttatgtaatgatgctcagggaattcttgctctgtatgaagcggcatttatgagggtggaagatgaaacaatactagataatgcgctcgagttcactaaagttcaccttgacatcatagccaaggatccttcttgtgactcttccctaagaacccaaatacaccaagcgttaaagcagccacttaggagaaggctggcaaggattgaggcgttgcattacatgcctatctaccaacaagaaacatcccacaatgaggacttactgaagcttgcaaaattagattttagcgtgcttcagtcgatgcacaaaaaggaacttagccacatttgcaaatggtggaaggatttggacctccaaaataagcttccttatgttcgagacagggtggtggaaggctatttttggatactatccatctattacgagcctcaacatgctcgaacaagaatgttcctaatgaaaacatgcatgtggttagtcgttttagatgatacatttgataattatggtacttatgaagaactcgaaatctttacacaagctgttgaaagatggtcaataagctgcctggatatgcttccagaatacatgaaactaatatatcaagagcttgtgaatcttcacgtggaaatggaggaatcacttggaaaaggagggaaaaacatatcaaattcactatgtcaaggaagatggcaaaaagagttgggttcgcaaattactttggtagaaaccaagatggctaaaagaggggtacatgcccaacctcttgaggagtacatgtctgtgtcaatggtgactggtacctatggcttgatgatagcgagatcttatgtcggcaggggtgatatcgtcaccgaggatacctttaaatgggtgtcctcgtatcctcctattataaaagcttcatgtgtgattgtaagacttatggatgatattgtcagccacaaggaggaacaagagagaggccatgttgcttcaagcatcgaatgctattctaaggaaagtggtgcatcagaggaggaagcgtgtgaatatatctcaagaaaagttgaagatgcatggaaagttataaaccgagagtcgctcaggcctacagctgtcccatttcctctacttatgcctgcaatcaaccttgcacggatgtgtgaagtcttatatagcgtcaacgatggcttcactcatgctgagggagacatgaaaagttacatgaaatcgttcttcgttcaccctatggttgtctaagattattctgtttgttctaatgtactaattaatttgtgggcttgttgcg

SEQ ID NO: 557 - DNA, 2026 bp, Artemisia annua
  putative sesquiterpene cyclase
tcgcccgggttggtacataatccaaacttctcatagacatgtctgttaaagaagagaaagtaattcggcccattgtccactttcctcctagcgtttgggcagaccagtttctcatcttcgatgacaagcaagcagagcaagccaatgtagaacaagtagtcaacgagttaagagaagatgtgagaaaagatttagtgtcatctttagatgttcaaacggagcacacaaatttgctaaaacttattgatgctatccaacgtcttggtatagcgtatcattttgaagaggagattgagcaagccttacaacatatttatgatacatatggtgatgactggaaaggcagaagcccttccctttggtttcgaatccttcggcaacaaggtttttatgtttcttgtgatatttttaaaaactataaaaaagaggatggttccattttaaggaatcccctcaccaacgatgtagaaggcttgcttgagctgtatgaggcgacatatttgagagtgcaaggcgaaggggttctagatgatgctcttgttttcacaaggacttgtcttgagaaaatagcaaaggatcttgttcacaccaacccaacactatctacctacatacaagaagcactaaaacagccgttacaaaaaaggttggcaagactagaggcattgcattacattcctatgtacgaacaacaagcatctcacaatgagtctttactcaaacttgcgaagctaggtttcaacttacttcaatcattgcatagaaaggagcttaacgaagtttccaggtggtggaaaggtcttgatgtcccaaacaatctaccttatgcaagagatagaatggttgaatgttatttttgggcactaggtgtctattttgagccaaaatattctcaagctaggatctttttagcaaaagtaatttcgctagcaactgttcttgacgacacttatgatgcttatggaacctatgaagaacttaagatctttactgaagcaattcaaaggtggtcgattacatgcatagatatgcttccagaatacctgaaactattataccaaggagtcttggatatatacatagaaatggaagaaataatgggaaaagagggaaaagcacatcatcttagctatgctaaagaatctatgaaagagtttattagaagctatatgatggaagcaaaatgggcaaatgaggggtatgtaccaacagcagaggagcatatgtcagttgcgtttgtaagcagcgggtatagcatgcttgccacaacatgttttgttggcatgggtgatatcgttacagatgaagcattcaaatgggctctgacaaaacctcctatcatcaaagcttcatgtgcaattgctagactcatggatgatattcactctcaaaaggaggagaaagaaagaatacatgttgcatctagtgttgaaagttacatgaagcaatatgatgtgacagaggagcatgtccttaaagtatttaacaagaaaatcgaggatgcgtggaaagatataacccgagaatcccttgtgcgtaaagatattccgatgcctctgatgatgcgagtgattaacttggcacaggtgatggatgttttatataaacataaagacggtttcactaatgtgggagaagaactcaaggatcatattaaatctttgctcgttcatcctatacctatataagttccgaaacttcatctcgtttttagcctccgatacactcaacaactcaactttctctcatcttcaaatggttggttgtggcaaatcttaagtccttgggtgattgaaatcttcaaatgcgtgtttgttactacatgcatgtgatttttttccccctcttctgtgtggcatttgtatttggatgatttaataataaataaaggtgtgtttgtgttatgcgaatgagaaagagggcgtctgcttgaatatttgaaaaagtgtttatttggtatgtttagtgaattaaagcatgctaaactgtaaaatttcaaccataataatacttaaatttcaacccc

SEQ ID NO: 558 - DNA, 1886 bp, Artemisia annua
  sesquiterpene cyclase
tattctaacatcgtatcagccttagaacatacctaagagcgatgtccacttttctagtttgtaatgcctcattctctccatcttatggtttaccatcatcatgtgatcgtaatagtagcatgaaccaagagatcgtccgcaacactgttaaatttcctcctagcatatggggagatcagtttcttacataccatgaaccgaaaaaaagtttaaccattgagaaacaacatgttgaagaggttgaagaaataaggaaaaagctattgaacacagcttttagtgagccaaagcagcatacgaagctaatacatcttatagattcagttcaacgccttggagtatcctatcattttgaacaagaaattgaggaagccttgcagcatgtctatgctacacatggtgatcagtggattggcaaggacaacctgaaaagtacatcacaatggttccgaatcctaagacaacaaggttttaatgtttcatctggaatcttcgagaaccatatggatgacaagggaaaatttaaggaacacttgagtgacgatgttcaaggcatgcttggtttgtatgaagcagcatatatgagtgtggaaggcgaaaaagaattagatgatgccctcgaattcactaaaactcaccttggaaacatagcaaaggatccttctcagaatgcttctttaagaaccaaaatagaacaagcactaaacagaccacttcggaaaaggatgccaaggctagaggcactgcattacatacctaaataccaacaagaagcttctcatgacgagaccttgttaaatcttgcaaagttggattataacatgcttcaatcaatacacaaaagggagattagtgaaatctgcaaatggtggaaggatttggatttctcaaacaaactaccgcatgttcgagatagattggttgaaatatatttttgggtattgggggtctattttgaacctcaacattatcgttcaaggatgtttctcaccaaaacgagtatgtggttaattgttcttgatgacacatatgataattatggtacttacgaagaacttaagatctttacggaagctgttcagagatggtccttaagctgcttggactcacttccagaatacatgaaattaatatatcgagaacttataaatcattaccaggaaatggaagaatcagttgaaaaggaaggaaaatcatatcaattattctatgctaaagagatggtaaaagaaaattgtcgaaacctcttagtggaagcaaaatggttaaaagaaggatacgtaccaacacttgaggaacacatgtcggtttcatgtgttacttatgcctatgctgtcatgatcgcaaactcttatgttggacgggaaaatatggttacagaggagtcctttaagtgggttgccaaatttcctcctcttgttaatgctacatgtttgattttaaggcttatggatgatatcgcgggccacgaggaggaacaagaaagagaccatgttgtttcaagtattgaatgctacagaaatgaaactggagcctcggaggaggatgccgttaagtttctttcaaaacaagttgaggatgcatggaaagttataaataaggagtgtctaaggcctacagaaattcccatgtctctaactatacctccactcagccttgctcgtgtgagtgatatcctttataaaacgaataatggttacaatcacgcaggggaagaagtgatcagttacattaagtcgctccttgttcatcctttagtttaatggcatttgatggttctcgatcagtactccgtcaatttatgtaacaccagcgatttcgcaaaaccttatgaataaacgaagatgatttacatgggtttctaaaaaaaaaaaaaaaaaaaaaaa

SEQ ID NO: 559 - DNA, 963 bp, Aspergillus terreus
  aristolochene synthase
atgaagaaacccaatggcacgaatggagcttccagctctcttgagccacccccctctacgttccaacctctctgccatccgctggtggaggaggtcagcaaggaggtggatggttacttcctccagcactggaactttcccaatgagaaggcccgcaagaagtttgtagctgcagggttctcccgggtaacgtgcctgtactttccgaaggcgctggatgaccgcatccactttgcctgccgtctgctgacggtgctgttcctgattgatgatctgctggaatacatgtcgttcgaggaaggttccgcttacaacgagaagctcatcccgatctcacgcggagatgtccttccagaccggtccattcctgtggagtacattatctacgatctgtgggagagcatgcgcgcccacgatcgcgagatggcagacgagatcctggagccggtgttcctgttcatgcgggcacagacggaccgcacccgagcccggccgatgggcttgggtgggtatctcgagtaccgcgagcgtgatgtgggcaaagagcttcttgctgcgctcatgcgcttctccatggggcttaagctgtctccgtccgagctccagcgcgtgcgcgagatcgacgccaactgctcgaaacatctgtccgtcgtgaacgacatctacagctatgagaaggagctctacacctccaagactgcccatagcgaaggcgggatcctttgcacctcggtgcagatcctggcccaggaggcggacgtgaccgcagaggctgccaaacgggtcctgttcgtcatgtgtcgggagtgggagctccgtcatcagttgctcgttgcacggctgagtgccgagggtctggaaacgcccggactggcggcgtacgtggagggactcgagtatcagatgagtggcaatgagctgtggagtcagacaacgttgcggtatagtgtggtagttgactag

SEQ ID NO: 560 - DNA, 3515 bp, Capsicum annuum
  5-epi-aristolochene synthase
gagaagtttatggtaattttgttaatactatcctatcattaaatgattatgtaaggtgtaaatattcaaattttcattttcaattcataattaataggattagtttagtaaaataagcctctattaaatattttatttcgaagagtgtcaagtcaacaagatcacctaaaacaaaacgcaacaagtatatcctaatatcccacgtgttatgtcgtaaaatgcatacaagttatgcctctgacacggaacagatatttttctttattcacaaaaatgcttctactttaatctttgttcagtgaccaaaaattatcttgcaaatatgttcttgtatgatgtcaggtagggcaactaggaaactattataagataaactcactcttataataattaataagtgatagattttccttgttctgtatagggtcaagtagggcgactgggagatattaaaagatggaggctcattctgttttttaattccccaatgatatgtctatcaccacaataaaaactagtccctcgtctaccaccaatttcatcaacaatgagaggggatttcattcttcctctaagaaccaacagcagtactcttattatctgttgcaacaatggcctcagttgcagttgaaaataatgttgtgaaccatattgcagaagagatcattcgccccgttgccgactattctccaagtatatggggggatcgtttcctctctttctccatcgacaaccaggtaattagttaatattcgtcatctttttttcatagtaccctccttgttctttgctggtattagacaacgtagtttgatttctttatactattggagatatttataggtcgaacaaaagtatgctcaagaaattgaaccgccgaaggaacaaacaaggagtatgttgttagcatccccaaggaaattgtcggatacattgaatttgattgatgttattgaacgtcttgcaatagcctatcactttgagaaagaaatcgatgagattttggatcggatttacaatgaaaattcaaacttcgagggcgatgtctataatgaagatctatgcacttgtgctctccaattccgattgcttaggcaacatggatataatatctctctaagtacgtacctcttgaagtactacaattgcaatattgtcacaattatacatagatatataatccgtttgatatgaaggccggctaatattgtgtattcttccttgaaaatcagaaattttcagcaaattcctagatggaaatggcagactaaaggagtctcttgctagtgatgtcctaggattattgagcttgtatgaagcttcacatgtaaggtctcatggtgaagacatcttagaagatgcactcgctttctccactactcatctagagtctgcaactccacatttggaatatcctcttaaggagcaagtgaggcatgcccttgagcaatctttgcacaaaggtattcctcgaattgagattcaattcttcatctcatcaatctacgacaagcaggcaataaagaatgatgtgttacttcgatttgccaaattggattacaacatgctccaaatgctgcacaaacaagaacttgctgaagtatcacggtgagattatataaaaacggtaaaaaattttgattgatcatttatcaagtaagtactgatgttaatttgttatgccgcaggtggtggaaagatttaaattttgtgaacacacttccatatgctagagatagagtagttgaatgctacttttgggcattaggagtatattatgagcctcaatattctcaagctcgtgtcatgctagttaagaccatagcaatgatttcgattgtggatgacacctacgaggcttatggtacagttgacgaacttgccatatacacggatgtcatacaagggtatggacttcatcaattcacttgctcaaatataccttgaaagagaatatcytgaaaaacattwaaccmrgcatttgctcattatatttatcctaatttaccttatctttgtcacctttcagatgggatattaaaagaattgatagtctgcctgattacatgaaaatcagttacaaagctcttctagatctttacaaggactatgaaaaggaaatgtctagagatggaagatctcacgttgtttattacgcaaaagaaagagtgagtctcaacgacttaactatcaatttacttttatcctttatacatttctgtctttgctttttcctcacatgtttttgtgaatataaactagaggtaattgggttacaattttctaacactttgaatttgtatgcttggttttcacagctgaaagaattggtaaaaagttataatattgaggcaaaatggtttattgaaggacatatgcctcctgcttctgaatacctgcgcaatgcatttgtaactaccacttactactatcttgccacaacatcgtatttggggatgaagtatgctaaggagcagcaatttgagtggttgtcgaaaaatcctaagattcttgaaggttgtgtgacaatatgccgagttattgatgacatagccacatacgaggtatgagactatgagttgtttctcataaagttgtaacatcataagttatttgaacaaatagattgttgttaacaatcgaagaaatgtaaaagctaacgcctaattaaatcgcctttgcaggtagagaaaaataggggacaactttcaactggaattgagtgctacatgagagattatagtgtatcgacaaaagaggcaatggctaaatttcaagaaatgggtgagtcgggatggaaggatattaatgaaggaatgcttaggccgactcccatacctatggagtttttatctcgcattctcaatcttgctcgacttgttgacgttacatataaacacaatgaagatggatacactcatcccgagaaagtcataaaacctcacatcattgcaatggttgttgactcgttcaaaatttaagctgccaatcgttggtcttaataaaatcttttcgagaaagtaatatgtttttatcattattattcggataaaaattcaatggagcttcatttgtagttgtgcagtgcattgccaaaatttatttatttttttcattatgtcatttcttccttgtacacctcaagtcgaccatttgaagtttctaatctagtatggttcatattgacttatgtactattatttccttttaccaaaatcaacaaaataatacttctcatagatgtttgtgttgtctttgctctcattctttctcattttattttttaggttttataaatsagaacaaaagtttwtaaaatttattcgctaacactactaaaaacttggctattagctgccaaggttagagaggaacaaattgtatatgtcgatatagtgagggactttgagasraagtctcacataacwaattaaatatttttatttttttattttttttaaacgacgatgggagatcycataaatatgatgatagtaaaagccatataatttcta

SEQ ID NO: 561 - DNA, 1918 bp, Capsicum annuum
  5-epi-aristolochene synthase
aacagcagtactcttattatctgaagcaacatggcctcagttgcagttgaaaataatgttgtgaaccatattgcagaagagatcattcgccctgttgccgacttttctccaagtctatggggtgatcgtttcctttctttctccatcgacaaccaggtcgaaacaaagtatgctcaagaaattgaaccgttgaaggaacaaacaaggagtatgttgttagcatccggaaggaaattgtcggagacattgaatttgattgatgttattgaacgtcttggcatagcctatcactttgagaaagaaatcgatgagattttggatcggatttacaatgaaaattcaaacttcgagggcgatgtctataatgaagatctatgcacttgtcgtctccaattccgattgcttaggcaacatggatataatatctctctaaaaattttcagcaaattcctagatggaaatggcagactcaaggagtctcttgctagtgatgtcctaggattattgagcttgtatgaagcttcacatgtaaggtctcatggtgaagacatcttagaagatgcactcgctttctccactactcatctagagtctgcaactccacatttggaatatcctcttaaggagcaagtgaggcatgcccttgagcaatctttgcacaaaggtattcctcgaattgagattcaattcttcatctcatcggtctacgacaagcaggcaataaagaatgatgtgttacttcgatttgccaaattggattacaacatgctccaaatgctgcacaaacaagaacttgctgaagtatcacggtggtggaaagatttaaattttgtgaacacacttccatatgctagagatagagtagttgaatgctacttttgggcattaggagtatattatgagcctcaatattctcaagctcgtgtcatgctagttaagaccatagcaatgatttcgattgtggatgacacctacgatgcttatggtacagttgacgaacttgccatatacacggatgtcatacaaagatgggatattaaagaaattgatagtctgcctgattacatgaaaatcagttacaaagctcttctagatctttacaaggactatgaaaaggaaatgtctagagatggaagatctcacgttgtttattacgcaaaagaaagactgaaagaattggtaaaaagttataatattgaggcaaaatggtttattgaaggacatatgcctcctgcttctgaatacctgcgcaatgcatttgtaactaccacttactactatcttgccacaacatcgtatttgggaatgaagtatgctaaggagcagcaatttgagtggttgtcgaaaaatcctaagattcttgaaggttgtgtgacaatatgccgagttattgatgacatagccacatacgaggtagagaaaaataggggacaactttcaactggaattgagtgctacatgagagattatagtgtatcgacaaaagaggcaatggctaaatttcaagaaatgggtgagtcgggatggaaggatattaatgaaggaatgcttaggccgactcccatacctatggagtttttatctcgcattctcaatcttgctcgacttgttgacgttacatataaacacaatgaagatggatacactcatcccgagaaagtcataaaacctcacatcattgccatggttgttgactcgttcaaaatttaagctgccaatcgttggtcttaataaaatcttttcgagaaagtaatatgtttttatcattattattcggataaaaattcaatggagcttcatttgtagttgtgcagtgcattgccaaaatttatttatttttttcattatgtcatttcttccttgtacacctcaagtcgaccatttgaagtttctaatctagtatggttcatattgactt

SEQ ID NO: 562 - DNA, 1953 bp, Cichorium intybus
  germacrene A synthase long form
gtttcattaaagatcatccaatccgaaaaatggctctcgttagaaacaacagcagcaatggtcgggagccagttctcagccccagaagtctcacaagtcctcgaggcttaaccagcccccgaccgttgtctgtccaaccgactccagagccggttcgacctttggccaacttcccaccttcgatctgggctgatcgcttcatctcattctctcttgataactctcaattggaagcttatgcaaatgcacttgaagaaccaaaagaagcagtgaagagtttaataaccgacactaccattgatgcaaacacaaaactgaaattgatttattcagtgcaccgtcttggtttgtcgtatctttatccagatgagattgatgccgaactcaacaaactcttcgagaagattgacttacagtattacgaacaagttgatttgtacactattgcagtacaatttcaagttttcagacaccatggttataaaatttcttctgatgtgtttaaaaagttcaaggacagtactacgggtacattcacggatgatgtaacaaaagacgtgaagggtatgctgagtttatacgaatcagcacacttaaggctacacggtgaagatatcttagatgaagctttagcattcaccgaagctcaccttaaaaaaatcctaaccacacttgaaggagatcttgcacgccaagtgaaccaagtcttaaaaagacccttccacactggaatgccaatggtagaggcacggctatattttatcacacacgaagaagatttttcaagccatgagtcggttgtaaagctagctaaagtccacttcaactatttgcaactacaacaaaaagaagaactacgactcgtgtcacagtggtggaaagatatgcaattccaacaatccgtcccttacataagagatagagtaccggagatatacctatggattttggggttatatttcgagccgtattactctcgggcacgtatcatagccactaaaatcacgttgttcttggtggttttggacgatacatatgacgcgtatgctacaattgacgagatccgatcgatcacagatgcgattaataggtgggaaattagcgcgatcgaccaacttcctgaatatatcaaaccgttctacagaattctcctcaacgaatatgatgacctcgagaaagaatactcaaaggacggaagagcgttcagtgtccacgcttcaaaacaagcgtttcaagaaatcgcgagagggtatcttgaagaggcggagtggttacacaacggttatgtggcaacatttcccgagtatatgaagaatggtttgattacttcggcttataatgtcatttcaaaatccgcattggtgggaatgggtgcgattgcagatgaagaggctcttgcttggtatgaaacacatccgaaaattttgaaagcttcagagttgatttcaaggctccaagacgatgttatgactttccagtttgagagaaaacgaggacaatcagcaactggtgtggatgcttatatcaaggaatacaatgtatccgaagaagtagcgatcaaagagctcatgaagatgattgaaaacgcatggaaagatataaatgagggatgcttgaagcccactgaggtctcggtggctctactaactcctattttgaatctcgcgagaatgatagatgtcgtatacaaattcgatgatggattcacctttcccgggaaaaccctaaaagactatattacccttttgttcgttagtcctccaccgagtctcgaaaactgataggttgtaatataagcatcatattttctcggaattttgctttttcatgttgcgtatgtttgcgactttcgctcaatttggtgagattctttttgacattctattgtataatcttcttttgttcaaataaaaagtttcttcttatggactaaaaaaaaaaaaaaaaaaaaaa

SEQ ID NO: 563 - DNA, 1755 bp, Cichorium intybus
  germacrene A synthase short form
atcaaacttagctatatcctttcaccttcaagaaatggcagcagttgaagccaacggtaccttccaagcaaacaccaaaaccacagagccggtgcgtcctttagccaacttccctccttctgtatggggtgatcgattcttgtcattctctcttgacactacggaattggaaggatatgcaaaagctatggaggagccaaaagaagaagtgagaaaactgatcgtagatccaacaatggattcaaataagaaactaagtttgatttattctgtacaccgtcttggtttgacatatctgttcttgcaagagattgaagcgcagcttgacaaactatttaaagagtttaacttgcaagattatgatgagtttgatctatacacaacttctattaactttcaagttttcagacaccttggtcacaaactgccatgtgatgtgtttaacaaattcaaggacagtagctcgggtacattcaaggaatccattaccaacgatgtgaagggtatgttaggcttatatgaatctgcacaattgagattaagaggagaacccattctcgatgaagcttccgcattcactgaaactcaactcaagagtgtagtaaacactctcgaaggcaatcttgcaaaacaggtgatgcaatcattgaggagaccattccatcaggggatgccaatggttgaggcaaggatgtatttctccaactatgatgaagaatgttccacacacgagtcattacctaagcttgcaaagcttcatttcaactatttgcagctacaacaaaaggaagaacttcgcattgtctcaaagtggtggaaggatatgaggttccaggaaactactccttacataagggatagagtaccagagatttacttatggatattgggattgtactttgagcctcgttactccttggcacgaatcatcgccacaaaaattacattgttcctcgtggttctagatgacacatatgatgcatacgctaccattgaagagattcgacttctgactgatgccataaacaggtgggacatcagtgctatggagcaaattccggaatatattcgaccattctacaaaattctcctagatgagtatgctgaacttgagaagcaactagctaaagaaggaagagcaaaaagtgttattgcttcaaaagaagcgttccaggacattgcaagaggataccttgaagaggccgagtggacaaacagtggatacgtggcatcatttccagagtatatgaagaacggtttaattacttctgcttacaatgttatttcaaaatctgctttagtgggtatgggcgagatggttggtgaagatgccttggcttggtatgaaagtcatccaaagacattgcaagcttcagagttaatttcaagactccaagatgatgtgatgacttaccagtttgagcgagaaaggggacaatcagccaccggcgttgattcttatatcaagacctatggcgtaacagaaaaggaagcgattgacgagctaaacaaaatgattgaaaatgcatggaaggatataaatgagggctgccttaagccaagagaagtctcaatggatttgcttgccccaattcttaatcttgcacgaatgatagatgtggtatacaggtacgacgatgggttcacttttccgggaaagaccatgaaagagtatattactctgttgtttgttggttcttcacccatgtaataataatttttatttcatatgtttaaaaaaaaaaaaaaaaaaaa

SEQ ID NO: 564 - DNA, 2005 bp, Cinnamomum tenuipile
  geraniol synthase
ctcttctatatgtaatgcctatgggcatttcggtttcttatcaacaaattggaacatggcattgcaaatgattgctccatttctatcctccttcctcccaaatcccagacacagcctcgcagcccatggcctcacacaccagaaatgtgtctcaaagcacatttcatgctccaccactacaccaacctactcaaccacagttccaagaagatcagggaactacaagcccagcatctgggactatgattttgtgcagtcactaggaagtggctacaaggtagaggcacatggaacacgtgtgaagaagttgaaggaagttgtaaagcatttgttgaaagaaacagatagttctttggcccaaatagaactgattgacaaactccgtcgtctaggtctaaggtggctcttcaaaaatgagattaagcaagtgctatacacgatatcatcagacaacaccagcatagaaatgaggaaagatcttcatgcagtatcaactcgatttagacttcttagacaacatgggtacaaggtctccacagatgttttcaacgacttcaaagatgaaaagggttgtttcaagccaagcctttcaatggacataaagggaatgttgagcttgtatgaagcttcacaccttgcctttcaaggggagactgtgttggatgaggcaagagctttcgtaagcacacatctcatggatatcaaggagaacatagacccaatccttcataaaaaagtagagcatgctttggatatgcctttgcattggaggttagaaaaattagaggctaggtggtacatggacatatatatgagggaagaaggcatgaattcttctttacttgaattggccatgcttcatttcaacattgtgcaaacaacattccaaacaaatttaaagagtttgtcaaggtggtggaaagatttgggtcttggagagcagttgagcttcactagagacaggttggtggaatgtttcttttgggccgccgcaatgacacctgagccacaatttggacgttgccaggaagttgtagcgaaagttgctcaactcataataataattgacgatatctatgacgtgtatggtacggtggatgagctagaactttttactaatgcgattgatagatgggatcttgaggcaatggagcaacttcctgaatatatgaagacctgtttcttagctttatacaacagtattaatgaaataggttatgacattttgaaagaggaagggcgcaatgtcataccataccttagaaatacgtggacagaattgtgtaaagcattcttagtggaggccaaatggtatagtagtggatatacaccaacgcttgaggagtatctgcaaacctcatggatttcgattggaagtctacccatgcaaacatatgtttttgctctacttgggaaaaatctagcaccggagagtagtgattttgctgagaagatctcggatatcttacgattgggaggaatgatgattcgacttccggatgatttgggaacttcaacggatgaactaaagagaggtgatgttccaaaatccattcagtgttacatgcatgaagcaggtgttacagaggatgttgctcgcgaccacataatgggtctatttcaagagacatggaaaaaactcaatgaataccttgtggaaagttctcttccccatgcctttatcgatcatgctatgaatcttggacgtgtctcctattgcacttacaaacatggagatggatttagtgatggatttggagatcctggcagtcaagagaaaaagatgttcatgtctttatttgctgaaccccttcaagttgatgaagccaagggtatttcattttatgttgatggtggatctgcctgattaaatgtagtaaatgtaaaatcggatattaaatttgcctagacatgttatgaatatttagatgtgcttccatgatatatatactaataaattagttctggtagcttaccatgagcaataaaaaaaaaaaaaaaaaaa

SEQ ID NO: 565 - DNA, 1719 bp, Cistus creticus
  germacrene B synthase
atgtttacccaaacatcattatcatcatcagctccagctctttcaacccaaaatgccaaacctgaaatcgttcgtcgatccgccggctttcatcccagcatttggggtgatcaattcctttcatatgcctccaatcctgtggttgaaaacgaagaagagaaaagggagcatgatttgctcaaaggaaaactcaaggagaagctaatgactgccgctgagaataagtcattgattgaggataaggagacacttgatttgattgatctaattcagagattgtgtgtctcttaccattttgaaaaggagattagccgcatcttggaacaaattatgcagctagtgacccacaacgaccacgaccacaaccacgatgatggagacctgtataccacttcccttaggtttcgtctcctacgacaaaatggttatagaattccttgcggtgtttttaacaagtttaaagatagtgaagggaacttcaaggaatccttgatttgcgatgttaaaggaatgttaagtttgtacgaggctgcacatctaaggattcaaggagaagatattcttgatgaggcattgtctttcactagcacacagcttggtgctgcaaagaccaccatcaccaccacaaacccttctcttgcagctcaagtggctcatgctttaaaacaacctatccgtaagggcttgccaaggcttcaagctaggcggttcatgccagtttatgaggctgatccttgtcatgacaaaaccttattaaccttcgcaaagttggatttcaatatgttacaaagactgcaccaaaaagaagtcggtgaaattacaaagtggtggaaagatatagacttctcaaacaagatgccttttgccagagacagagttgtagaatgttacttttggaccttaggagtgtattttgagccaaaatacacattgggtcgaaagatttttaacaaagtaatagcaatgacttctgttcttgatgacatttatgatgtttatggaacccttgatgaacttgagatatttacagaagctatcctgaggtgggatatcaatacaataagtcaacttccaagttacatgcaaatttattatcaagcatttattgatgtttatagtgaaatggaggcacaaatggaagtagaagacaaattatactgcgttccttatgcaaaagaagttatgaaaaaactagtcagggcataccaccaagaatcaaaatggttccatgcgaattatgtgccgccgatggaggagtacatgtccgttgcattggttagctccggttatgaagtgcttgccgccacatcctttgttggaatgggagatgtcgtcaccaaagactcttttgagtggttgttcaattaccccaagataatcactgcttctctaattatgggtagactcatgaatgatattgtaggtcacaagtttgagcaaaagagaggtcatgtagcttcggctgttgaatgttacgtgaaacaatacggaggaacagaagaagaagccgtagaggaatttcggaaacaaattaccaatgcatggaaggatatcaatgaggaatgcttatgcccaacggcagtgccgatgcctctccttactcgcgtactcaaccttgcgagagttcttgaagtcatttacaatattgatgattgctacacaaattccaaactcatagtcaaggacattgcttctctgctcatcaatccggtcccatga

SEQ ID NO: 566 - DNA, 1867 bp, Citrus junos
  (E)-beta-farnesene synthase
caactcctactcttaaaaacaaactatatagttgtatttggtttgtctgaaacggaatgaaagatatgtctattccacttctagcagcagtttccagttcaactgaagaaactgttcgtcccattgcagattttcatcctaccttatggggaaaccatttcctgaaatccgctgccgatgtcgagacaattgacgctgcaactcaagaacagcacgcagcactgaagcaagaggtcaggaggatgataaccactactgccaataagcttgcccaaaaactacacatgattgatgcagtacaacgattaggtgtcgcttatcattttgaaaaagagattgaagatgaattgggaaaggtatctcacgatcttgacagtgatgatctatacgttgtttctcttcgttttcgactttttagacagcaaggagttaagatttcatgtgatgtgtttgataagttcaaagatgatgaaggtaaattcaaggaatcattgatcaacgatatacgaggcatgttgagtttgtacgaggcagcatacctagcaattcggggggaagacattttagatgaagccattgttttcactaccactcaccttaagtcagtaatatctatatctgatcattctcatgcaaactctaatcttgctgaacaaatacgtcattctctgcaaattcctctccgtaaagccgcagcaaggttagaggcaaggtattttttggatatctattcaagggatgatttgcatgatgaaactttgctcaagtttgcaaagttagactttaatatattacaagcagcacaccagaaggaagcaagtatcatgaccaggtggtggaacgatttaggcttccctaaaaaggtgccttatgcaagagatagaataatagagacatatatctggatgttgctgggagtgtcctatgagcccaatttggcatttggtagaatttttgcatccaaagtggtgtgcatgataaccacaatagacgacacatttgatgcttacggtacttttgaagagctcacactttttactgaagcagtcacaagatgggacattggcctcatagatacactgccagaatacatgaaatttattgtcaaggcactcttagatatttatagagaagctgaggaagaattggcaaaggaaggaagatcgtacggcataccatatgcaaaacagatgatgcaagaattaattatattgtactttaccgaagccaagtggttatataaaggttatgttccaaccttcgatgaatacaaatcagttgcattaagaagtatcggtttacgtacgctagcggtcgcttccttcgttgatttgggtgattttattgcaacgaaggacaattttgaatgcattcttaaaaacgctaagagtcttaaagcgacagaaaccattggcaggctcatggatgacatagcaggttataagtttgagcagaagagaggacataatccctcagcagttgagtgctacaagaatcaacatggcgtctccgaggaagaggcagttaaagaattgttgttagaagttgctaacagttggaaagatataaatgaggagcttctcaacccaacgactgtcccgttacctatgcttcaacggcttctttatttcgcacgttcaggccattttatctacgacgatggtcatgatcgctacacccattcattgatgatgaaacgccaagttgccttgttgctgacggaaccccttgcgatctgaagattaacgtcatgctgttgattttccatcgggtatatttgagcagttgtaataaatgaaggtcgcgctggctatttagctagctactcatgcctggctaataaatgtgtcgccaataatatggtttc

SEQ ID NO: 567 - DNA, 1900 bp, Citrus junos
  terpene synthase
cgtgggtgaagtaatcagttcctttggtttgagtgtgaaaaagaaaaaaaaaatgtccgctcaagttctagcaacggtttccagttcgacagaaaaaactgttcgtcccattgctggtttccatcctaacttatggggagactatttcctgaccctcgcttctgattgcaagacagatgatactacgcaccaagaggaatacgaagcgctgaagcaagaagtcagaagcatgataacggctacggcagatacacctgcccagaagttgcaattggttgatgcagtccaacgattgggtgtggcctatcacttcgaacaggagatagaagatgcaatggaaaagatttatcacgatgactttgataataacgatgatgtcgatctctacactgtttctcttcgttttcgactgcttaggcagcaaggatttaaggttccgtgtgatgtgttcgcgaagttcaaagatgatgaaggtaaattcaaggcatcattggtgcgggatgttcatggcattctaagtttgtatgaggcaggacacttggccattcgcggagaagggatattagatgaagccattgctttcactagaactcaccttcagtcaatggtatctcaggatgtatgccctaataatcttgctgaacaaattaatcatactctcgactgtcctctccgcagagcccttccaagagtggagacaagatttttcttgtcggtctatccaagagatgataaacacgataaaactttgttaaagttttcaaagttagactttaaccttgtgcaaagaatacatcagaaggaattaagtgccatcacacggtggtggaaagatttagacttcactacaaagctaccttatgcaagagacagaatcgtagagttgtatttttggattgtagggacgtattttgaaccaaagtacactttagcaagaaaaataatgaccaaaacaatttacacggcatctatcatagatgacactttcgacgcttatggcttctttgaagagctcaaactctttgcagaagcagtccagaggtgggacattggagccatggatatacttccagaatacatgaaagtgctttataaggcccttttagatactttcaatgaaattgagcaagacttggccaaggaaggaagatcgtcctgcttaccttatggcaaagaaaagatgcaagagcttgttcaaatgtactttgttcaagccaagtggttcagtgaaggttatgttccgacatgggacgaatattatccggttggacttgtaagttgcggctacttcatgcttgcgacaaattccttccttggcatgtgtgatgttgcaaacaaggaatcttttgaatggatatccaggaccctaagatttcaacagcgtcatcagtttatctgcagacttaggaatgacattgtttcccaccagtttgaacagaagagaggacatattgcctcaggagttgaatgctacattaagcagtatggtgtttcagcagaagaggtagttacagtttttactgaagaagttgagaatgcatggaaagatatgaatgaggaattcctgaaaccaactgcttttcctgtggctttgattgagagacctttcaatatcgcacgtgtgattgaatttctaaacaagaagggtgattggtacactcattctcatgcgattaaagaccagattgccgcagtgctcagagaccctgttaccatctgaagagttataagtatttctgtcagttacatttcatggtgttttcagaataaatggtgtttgtatcaagggattgagttactcttcatctcctgctgtttgggataaaatgtaaaagagattgggttatcgttgatctctgatgtgccgtgtgcggaataaattgtattttgatccactact

SEQ ID NO: 568 - DNA, 2043 bp, Citrus limon
  (+)-limonene synthase 1
ggccaagtataactgtaagctagcttacactacatctgtatatccaatgtcttcttgcattaatccctcaaccttggttacctctgtaaatgctttcaaatgtcttcctcttgcaacaaataaagcagccatcagaatcatggccaaatataagccagtccaatgccttatcagcgccaaatatgataatttgacagttgataggagatcagcaaactaccaaccttcaatttgggaccacgattttttgcagtcattgaatagcaactatacggatgaagcatacaaaagacgagcagaagagctgaggggaaaagtgaagatagcgattaaggatgtaatcgagcctctggatcagttggagctgattgataacttgcaaagacttggattggctcatcgttttgagactgagattaggaacatattgaataatatctacaacaataataaagattataattggagaaaagaaaatctgtatgcaacctcccttgaattcagactacttagacaacatggctatcctgtttctcaagaggttttcaatggttttaaagacgaccagggaggcttcatttgtgatgatttcaagggaatactgagcttgcatgaagcttcgtattacagcttagaaggagaaagcatcatggaggaggcctggcaatttactagtaaacatcttaaagaagtgatgatcagcaagaacatggaagaggatgtatttgtagcagaacaagcgaagcgtgcactggagctccctctgcattggaaagtgccaatgttagaggcaaggtggttcatacacatttatgagagaagagaggacaagaaccaccttttacttgagctcgctaagatggagtttaacactttgcaggcaatttaccaggaagaactaaaagaaatttcagggtggtggaaggatacaggtcttggagagaaattgagctttgcgaggaacaggttggtagcgtccttcttatggagcatggggatcgcgtttgagcctcaattcgcctactgcaggagagtgctcacaatctcgatagccctaattacagtgattgatgacatttatgatgtctatggaacattggatgaacttgagatattcactgatgctgttgagaggtgggacatcaattatgctttgaagcaccttccgggctatatgaaaatgtgttttcttgcgctttacaactttgttaatgaatttgcttattacgttctcaaacaacaggattttgatttgcttctgagcataaaaaatgcatggcttggcttaatacaagcctacttggtggaggcgaaatggtaccatagcaagtacacaccgaaactggaagaatacttggaaaatggattggtatcaataacgggccctttaattataacgatttcatatctttctggtacaaatccaatcattaagaaggaactggaatttctagaaagtaatccagatatagttcactggtcatccaagattttccgtctgcaagatgatttgggaacttcatcggacgagatacagagaggggatgttccgaaatcaatccagtgttacatgcatgaaactggtgcctcagaggaagttgctcgtcaacacatcaaggatatgatgagacagatgtggaagaaggtgaatgcatacacagccgataaagactctcccttgactggaacaactactgagttcctcttgaatcttgtgagaatgtcccattttatgtatctacatggagatgggcatggtgttcaaaaccaagagactatcgatgtcggttttacattgctttttcagcccattcccttggaggacaaacacatggctttcacagcatctcctggcaccaaaggctgatgatgaattataatgcatgatgcgttgcgaattcccagagagtgcagtttcagttgatgttggcctccacttttctttcttctgagggatctcttttcgataataaaataaattccctcattcaaaaaaaaaaaaaaaaaaaaaaaaaaaaaaaaaaaaaaaaaaaaaaaaaaaaa

SEQ ID NO: 569 - DNA, 1991 bp, Citrus limon
  gamma-terpinene synthase
atagaatccttgaaattatattctaagtcatggctcttaacctgctatcttcactacctgcggcatgcaatttcaccagattatcattaccattatcaagcaaagttaatggctttgttcctcctattactcaagtccaatatcccatggctgcatccacttcttctattaagcctgtcgatcaaaccattattaggcgatctgccgattacgggccaaccatttggagttttgattatattcaatcacttgacagtaaatataaaggagaatcgtatgccagacaattggaaaagctgaaggaacaagtaagcgcgatgctacagcaggataataaagtggtggatttggatcctttacatcaacttgagctcatcgataatctgcacagacttggagtatcttatcactttgaggatgaaataaaaagaactttggataggatacacaacaagaatactaataaaagtttatatgccagagcactcaaatttagaatcctaaggcaatatggttacaaaacccctgtaaaagaaactttttcacgtttcatggatgagaaggggagctttaagttatcaagccacagtgacgaatgcaaaggaatgttagctctgtatgaagctgcatacctcctggtagaagaagaaagcagtatctttcgtgacgctataaggttcaccaccgcatatctcaaagaatgggtggccaagcatgatattgacaaaaatgataatgaatatctttgtacattagtgaaacatgctttggaacttccactacattggaggatgcgaagattggaggcaaggtggttcatcgatgtatacgaaagtggaccggacatgaaccctatcttgctcgagcttgctaaagttgactataatattgtgcaagcagtacaccaagaggatctcaaatatgtgtcaaggtggtggaagaaaacaggacttggggagaagttgaattttgcaagagacagagtagtggagaatttcttctggactgtgggggatatattcgaacctcagtttggatattgtagaaggatgtctgcaatggttaattgtcttttaacatcaatcgatgatgtttatgatgtctatgggaccttggacgaacttgagctattcactgatgcagttgagagatgggacgctactacaacagagcaacttccgtactatatgaagctgtgctttcatgctctctataattccgtaaatgaaatgggttttattgctcttagagatcaagaagttggcatgatcattccttatcttaagaaagcgtgggcagatcaatgcaaatcatatttagtggaggcaaagtggtacaacagcggctacataccaactcttcaagaatatatggaaaacgcttggatttcagtaacagcacctgtaatgctactccatgcgtatgcttttacagcaaatccaataacaaaggaggccttggaattcttgcaggattctcccgatataattcgtatttcatcaatgattgtacgacttgaagacgatttgggaacatcatcggatgagctgaagaggggagatgttcccaaatcaattcaatgttacatgcatgaaactggagtttcagaggatgaggctcgtgaacatatacgagatttgattgctgagacatggatgaagatgaacagtgctcgattcggaaacccaccttacttgcccgatgtttttattgggattgcaatgaatttggtgaggatgtctcaatgcatgtacctatatggagatggacacggtgtacaagaaaataccaaggatcgtgtgttgtctttatttattgatcccattccttaattatgaaaatttctcataataaggatttacagtcatgtactagatctcccaaataaacatgcagttgcgtactataagactcattactgtggtcaccaaatcgttcctcctcataataaataaatattatttgaagtctctaaaaaaaaaaaaaaaaaa

SEQ ID NO: 570 - DNA, 1647 bp, Citrus sinensis; identical to SEQ ID NO: 1
  terpene synthase 1

SEQ ID NO: 571 - DNA, 1877 bp, Citrux x paradisi; identical to SEQ ID NO: 294
  putative terpene synthase

SEQ ID NO: 572 - DNA, 1837 bp, Crepidiastrum sonochifolium
  germacrene A synthase
aaccaacctcaaaatagtcaccaatcaacaaatcgagcttaaaacatctccattcaattacttcacaaaatggcagcagttgaagccaatggtacccttcaagcaaacaccaaaaccaccactgagcctgttcgccctttggccaatttccctccttctgtatggggtgatcgtttcttgtcattctctcttgacaataaggaattggaaggatatgcaaaagccatggaggagcccaaagaagaattgagaagattgattgtggattcaacaatggattccaacaagaaactaagtttgatatattcggtacaccgtcttggtttgacatatcttttcttgcaagagattgaagcacaacttgagaaactcttcaaagagtttaacctgcaagattatgatgaagttgatctatacacaacttctattaactttcaagttttccgacaccttggtcacaaacttccttgtgatgtgtttaacaaatttaaagacagtacctcgggtaaattcaaggaatacatcaccaacgatgtgaagggtatgttagggttatatgaatctgcacaattgcgagttagaggtgaatcgattctagatgaagcttcagctttcactgaaactaaactcaaaagtgttgtaaacactctagaaggaaagcttgaagaacaagtgatgcaatcattgaggagaccatttcatcaagggatgccaatggtggaagcaaggctatatttctccaactataccgaagaatgtgcaacacatgcatctttactaaagcttgcaaagttgcattttagctatctggagcttcaacagaaggaagaacttcgtatcgtgtcacagtggtggaaagatatggagtttcagacatcggtcccttacataagagatagagtaccggagatatacctatggattttgggattgtactttgagcctcgttactcattggcacgaatcatcgccacaaaaattacattgtttcttgtggtgctagatgacacatatgacgcgtatgctaccattgaagaaattcgccttcttacggacgccataaataggtgggacattagtgccatggagcaaattccggaatatattcgaccattttacaagattctcctcgaggagtatgctgaacttgagaaacagctagctaaggaaggaagagaaaaaagtgttattgcttcaaaacaagcgttccaagacattgctaacggctaccttgaagaggccgagtggacaaacagtggatatgtggcaacatttccagagtatatgaagaacggtttaattacttctgcgtacaatgttatttcaaaatcagctttggtgggtatgggtgagatggttagtgagcatgctttggcttggtatgaaagtcatccaaagacattgcaagcttcggagttaatttcaagactccaagatgacgtcatgacttaccagtttgagcgagaaagggggcaatcagccactggcgttgattcttatatcaagacgtatggcgtttcagagaaggaagctattgacgagctcaataaaatgattgaaaatgcgtggaaggatataaacgagggctgtttgaagccaagagaagtttccatggatgtgcttgcaccgattcttaatcttgcacgaatgatagatgtggtatataggtacgacgatgggttcacttttcccggaaagaccatgaaagagtatactactctattgtttgtaggttcttcacccatgtaataataaaatattgaatgttgtttcttatgtttatgatatttttcgatgaataataaatattttatcgaccggtaaaaaaaaaaaaaaa

SEQ ID NO: 573 - DNA, 2490 bp, Croton sublyratus
  copalyl diphosphate synthase
atgtcttctcaggcgttctctcttctgtcttcccttccttcctcttctttttctagcactcgtcctcgtcttttcctaggtgtttggtacgagcttcaaggccagcggataagctttaatcttcgcccaagatgcactgacttatccatcacttacactaacgaatatgtccacggagaaatggcagtgattaacccgccggaagatgatacagaagagcaagtacctaaggtgacgaattccatttgcgtgaaatttaataataaagaaaaaaagagctacatttatgattatgagtataatttgattttaaagttgttgattaaggttgcgatatcaaaagagataatgagaagtgtagagagaattaaaaagatgctgaaatccatggaggatggagaaataaacatatcagcatatgatacagcttgggtacgtctagttaaagatgtaaatggaagtggagaacctcaattcccatcagctcttcagtggatttcaaataatcaattaccagatgggtcttggggtgatgctcttgtttttaatgcgcatgatcgtattctcagtactctggcttgtgttgtcactctcaagtcctggaatttacaccctcataaggttgcaaaaggtctgaaattttttaaagaaaatctgagcaaacttgaagaggagaacgaggagcacatgtctattggatttgaagtggtttttccttcacttctggagcttgcaaggaaattagacattgacgttcctgatgattctcatgtcttacaacagatttgtgaatgcagaaatacgaagctcaaaaagatacccaaagatataatgcacaaaatgcccacctcactactccatagcttggaaggaatgcctgatcttgagtgggaaaagctcttaaaattacagttcgacaatggctccttcctcttctctccttcctccactgcttacgctttcatgcaaactcaagatgataaatgtttaatctatttaaacaggattgtccaaagatttaatggtggagtaccgaatgtttatccagttgatcttttcgagcacacttgggctgctgatcgcttgcaacgccttggaatctcgagattatttgagcaagagcttaaagaatgtatgaattacgtcgctagatattggagagaagatgggatgtgctgggcgagaaattctaatgttcgtgatgttgatgactcgtcgatgggattcagaatgcttagattatatggtcataatgtttctgcggatgtgttcaagaaattcaaaaaagatgatacttgggtctgcatgcctggacaatcaacgcaggccattaccggaatgtataatttgtttcgagcttctcaggttctatttccaggagaaatgattcttgaagaagctagggaattttgttatgatttccttagggaaaagcaatctgctaatgcagtcgtagataaatggattatttccaaggatttaccaggagaggttgcatatgcgttggatgtgccatggtttgccagcttacctacagttgaggcaagattctatattgaacaatacggtggagatgatgatgtatggattggtaaggttctgtatagaatgccatttgtgaataacaatgagtatttggaacttgctaagtttgactacaatagttgccaagcactgcaccgtgctgaatgggacaattttcaaaagtggtatgatgaatgtaatttgggggattttggggtaagtaaaagagagcttctactagcatattacataagcgcagcaagcatttttgagccagaaaagtctaaagaaaggcttgcatgggccaaaactagtattttgctacaaactattgatgcttatttccacaccaacaactccattgaggagaggaaagatttcgtacaccaatttaacatggagctcctgctccctcacttggaatggaatagacaggaaaatggaagagaagacaaagcaggaacttgtcggaattatacttggaaccttaaacgatgtcccttggatgcactggtggctcatggcacagacattagtcacagtttgcgtcatgcttgggaaattgggctcacaaattgggaaaaagatggagacaagcaccgcggaaaagcggaacttattgtgaaaactattaatctaacaactggtccttgggtgtccgaagaacttttaaactgtaattctaaatatgaaaagttgtttcaactttctaattatttgtaccatcagcttggtcattttaacaaaaacaaggtggatgataaaaagaaatacacaactccagaaatagagtcaagcatgcaggaattggctcaattggtgctccaaaattcatcagacggacttgattctaatatcaagcaaactttctttacagtggttaaaagtatttactacactactgtttgcgatctcggaactaccaattaccatatgtccaaagtgctctttgaaagagtatattaa

SEQ ID NO: 574 - DNA, 1716 bp, Cucumis melo
  delta-cadinene synthase
atgtcttctcaagtttcaaattttcctgcttccattatgaaaaccaatgatattcctgatgttaagcgttctcttgcaaattttcatcctaatatttggaaggaacatttcctttcatttacatttgatgatgcattgaaaatagatgagggcatgaaagaaagaactgaaaagttgaaagaagaaataagaatgatgatgattgcttatgtggaaaatcaactgattaagctaaatttggttgattcaatccaacggctaggagtatcctatcattttgaagatgaggttgatgaattcttagaacatatatatgtgtcttataataattcccttttattgagtaataaaaatagtaatggtgaagatcttcatattactgctcttctatttcgacttctgaggcaacaaggttataggatttcatgtgatatatttttgaagttcatggacgacaatggaaaattcaaagagtcactggttgaggatgaaagaggattattgagcctatatgaagcatcacatatgatgggacatggagaagctttgctcgaggaagctcttgaatttacaaccacacatcttcaaacatatattcatcgttactcaaatattaatccaagttttgcatctgaagttagtaatgcattgaaattgcctattagaaaaagtgttccaagaatcaaggcaagagagtatttggaaatttaccaacaacatccttctcacaatgagactttgcttgaattctcaaaactagacttcaacatattacaaaaacttcatcaaaaggagctaagtgaaatctgcaggtggtggaaggatttggatgttccaacaaagtttccttttgcaagagatagaattgtggagtgttatttttggacgttgggagcatactttgaacctcaatacagtgttgggaggaaaatgttaacaaaagtaattgcaattgcttcaattttagatgatatttatgatgcctatggaacatttgaagaactccaagtgctcactccagcaattcaaaggtgggatagaagcatggtgcatacacttcctctgtacatgaaacctttttatgtagcaatgttagaactttatgaggaaattggcaaagagattgacaaggatcaaaattctctccaccttcaagttgcaataggaggaataaaaaggctatctgaatcctattttgaagaagctaaatggttaaataaggagtataaaccaagtttcaaggagtacatggaactggcattaaagaccacaggttataccatgcttatatccatttcttttcttggattgggtgatcacattgtaacaaacgaggttcttcaatggctttcaaatggacctcaaattattaaagcctcgaccatcatttgtagactcatggacgacatcgcttcccacaagtttgaacaagaaagggagcatgtagcttctgctgttgaatgttacatgaagcaatatgattgttcagaagaagaagcttgcattgaacttcataaggaagtggttgatgcatggaaggatacaaacgaagcattttatcgtccatttaatgttccagttccagttctaatgcgcgtactcaatttttcaagagttataaacttgctttatttggatgaagatggatacacaaatgcaaagagtggaacaaagtttcttattaaatctcttcttgttgacccactgccttgttaa

SEQ ID NO: 575 - DNA, 1683 bp, Cucumis melo
  alpha-farnesene synthase
atgagttcaaacatatcagcaattccaaactctttggaggtgattcgaaggtctgcacaatttcaagcaagtgtttggggagactattttctttcctatcattctctttctccggaaaaaggcaacaaggtgatggaaaaacaaacggaagaattgaaagaagaaataaaaagggagttgaattctacaaccaaagacgaagaacctgagaaattgagactcatcgattcaatccaacgcttaggcgtttgttatcatttcgaatatgagatcaacaaaatacttgaacaactccatcatattactattacttcaaaaaataatggtgatgatcatccttacaatatgaccctccgtttcagacttctaagacaacaaggctacaacatatcatcgaagtcattcgaaaggtttcgaggcaaatgggaaagttcgtacgataaaaatgtagaagaactcttgagtttatatgaagcatcgcaattgaggatgcgaggagaagaagcattagacgaagcgtttcgtttcgctaccgctcagttggaagccattgtccaagacccaacaaccgatccaacggtcgtaggggaagtctgccaagctttgaagtggccgatgtacaagaacctaccaaggcttcaagcaagtcactacattggtttgtacagcgagaagccatggaggaatgagagtttgcctaactttgcaaagatggatttcagcaaactgcaaaagcttcatcagaaagaaattgcttacatctcaaagtggtgggatgattatggttttgctgaaaagctatcatttgcaaggaacaggattgtggagggatacttttttgctcttgggatattctttgaacctcaactttcaactgctagacttattatgaccaaaattattgctattggatcagtgttagatgacatttatgatgtttatggcactttcgaagaactcaaactcttgacgcttgcacttgagagatgggataagagtgagacaaaaaaacttccaaaatatatgaagatgtactacgaggctttgttagatgtttttgaagaaattgaacaagaaatgagccaaaaggaaacaacaccatattgcatccatcagatgaaagaagcgacaaaggagcttgggagggtatttttggtagaggccaaatggtgtaaggaaggatacaccccaacagtagaagaatacttggatattgctttaatatcttttggccacaaattgcttatggtaacagctctcttaggaatgggttcaaccattgccacacaacaaattgttcaatggatcacctccatgcctaatattctcaaagcctccgctattatttgtaggctcatgaacgacatcgtttcacataagtttgaacaagagcgaggtcacgtggcttctgccattgaatgttacatggaacaaaattatatgtcagagcatgatgtcctaattatattaggtaaacaaatagatgagttttggaaggatatggttgagaattattgtgttgttatcaccgaagaagaggttccaaggggtgttcttatgagagttttgaaccttacaagattatttaatgtgatttacaaagatggagatggatatacacaatctcatggttccacaaaaacccatatcaaatctttgcttgttgactctcttccactctag

SEQ ID NO: 576 - DNA, 1903 bp, Cucumis sativus
  (E,E)-alpha-caryophyllene synthase
tctcacccatagttcaaactctcaagccaataacatacacatctttctatttagcaagaggattatcccaactaccttttctatctttcttttctactttgaaaagtcatgtcttctcattttcctgcttccattatgaaaaccaatgatatttatgatactaagcgttctcttgcaaattttcatcctactatttggaaggaacattttctttcattcacatttgatgatgcattgaaagtagatggtggcatgaaagaaagaattgaaaagttgaaagaagaaataaggatgatggtgattgcttctgtgcaaaatccattggtaaagctaaatttggttgattcaatccaacggctgggagtatcttatcattttgaagatgagattgatcaattcttagaacatatgtatgtgtcttataataattcccttttattcagtagcaacgatagtcaagatgatgatcttcatatttctgctcttctatttcggcttctcaggcaacatggttataggatttcatgtgatatatttttgaagttcatggacaacaatggaaaatttaaagagtcattggttgaggatgaaagaggaatattgagcctatatgaagcatcgcatatgagggggcatggagaagcattgcttgaggaagctcttgaatttacaaccacacatcttaaagcatatattcatctttactcaaatattaatccaaattttgcatctgaagttagtaatgcattgaaattgcctattagaaaatgtgttccaagagtcaaggcaagagagtattttgaaatttaccagcaacaaccttctcacaatgagactttgcttacattctcaaaactggacttcaacatcttacaaaaacttcaccagaaggagatagctgaaatctgcaggtggtggaaggatttgaacgtttcaacaaactttccgtttgcgagggatcgaattgtggagtgttacttttggatattgagtatatattttgaaccttatttcaagtttggaaggaaaatattgactaaagtgattgctatgacctcaattatggatgatatatatgatgcttatggaacattcgaagaactccaacttttcaccttagcaatcaaaagatgggacatgagcatggtcaatctacttccgcagtacatgaaagttcattatacaactctgcttgatctttttgaagagatggataaggggatagtcaatgatggaatatcctatcgctcttgctttggaaaagaagctatgaaaagacaagctgaatcctatttcaaagaagctgaatggctaaacaaaaattataaaccaaaatatggagaatacatggaagtggctttagctagttcaggttatgaattactttcaactatttcatttgtttgcatgggtgacattgcaacaaaggaagtatttgaatggctttttgactgtccccaaattcttaaagcctcaaccaccatttctagactcatggatgatgttgtctcctacaagtttgagaaagaaagagaacacattgtttctgcagttgaatgttacatgagcaatcatggacgctcagaagatgaaacatgtgctgagttacttaagcaagtagaagatgcatggaagactataaatgaatgttgccttcatccaatgaatgttccaatgccatttttaatttgtctattaaatctcacaagagttatggctctcctttattctcacgaagatggatatacaaattctaagggtaggactaaacttcttattcagtctctacttattgatccattgcatttgtaattggtgtctgtcaccaaattctaacttttgttatatttttaattatttaaaaaagctgcttaaaaaaaaaaaaaaaaaaaaaaaaaaaaaa

SEQ ID NO: 577 - DNA, 1895 bp, Cucumis sativus
  (E)-alpha-farnesene synthase
ctcacaaaaagctaaagctaatttcgacagcaaacatatatagatatatatatttttcttaaaaaaaaaaggagaatgagttcaaacgtatcagcaattccaaactcttttgaattgattcgaaggtccgctcaatttcaagcgagtgtttggggagactactttctttcctatcattctctccctccggaaaaaggcaacaaggtcatggagaaacaaacggaagaattgaaagaagaaataaaaatggagttggtttctacaacaaaagatgaacctgagaaattgagactcatcgatttaatccaacgcttaggcgtttgttatcatttcgaaaatgaaatcaacaacatacttcaacaactccatcatattactattacttcagaaaagaatggtgatgataatccttacaatatgactctttgtttcagacttctaagacaacaaggctacaacgtatcatcggagccattcgataggtttcgaggaaaatgggaaagttcatacgataacaatgtagaagaactcttgagtttatatgaagcatcgcaattgaggatgcaaggagaagaagcattagacgaagcgttttgttttgctaccgctcagttggaagccattgtccaagacccaaccaccgatccaatggttgcagcggaaatccggcaagctctgaagtggccgatgtacaagaatctaccaaggcttaaagcaagacaccacattggtttgtacagcgagaagccatggaggaatgagagtttgcttaactttgcaaagatggatttcaacaaactgcaaaaccttcatcagacagagattgcttacatctcaaagtggtgggatgattatggttttgctgaaaaactgtcatttgcaaggaacaggattgtggagggatatttttttgctcttgggatattctttgaacctcaacttttaaccgctagacttattatgaccaaagttattgctattggatcaatgttagatgacatttatgatgtttatggcacttttgaagaactcaaactcttgacccttgcacttgagagatgggacaagagtgaaacaaagcaacttccaaattatatgaagatgtactacgaggctttgttagatgtttttgaagaaattgaacaagaaatgagccaaaaggaaacagaaacaacaccatattgcatccatcacatgaaagaagcgacaaaggagcttggaagggtatttttggtagaggccacatggtgtaaggaaggatacaccccaaaagtggaagaatacttggatattgctttaatatcttttggccacaaattgcttatggtaacagctctcttagggatgggttcacacatggccacacaacaaatcgttcaatggatcacctccatgcctaatattctcaaagcctccgctgttatttgtaggctcatgaacgacatcgtttcacataagtttgaacaagagcgaggtcatgtggcctctgccattgaatgttacatggaacaaaatcatttatcagagtacgaagccctaattgcattacgtaaacaaatagatgatttatggaaggatatggttgagaattattgtgctgttatcacagaagatgaggttccaaggggtgttcttatgagagttttgaaccttacaaggttatttaatgtgatttacaaagatggagatggatatacacaatctcatggctccacaaaagcccatatcaaatctttgcttgttgattctgtaccactctaaatctttttaattcaaaagctctctcttacacaaaaatattgttatgtttatgttttgattattgtatttgtatgattttatatatgtatataataatgttcttacgaaaaaaaaaaaaaaaaaaaaaaaaaaaa

SEQ ID NO: 578 - DNA, 2637 bp, Cucurbita maxima
  copalyl diphosphate synthase 2
atgtcctcctcctcctctctctctctctctcgccattgcctgtcttcttctttttccttccgtctcccaaacctcttcccaccacctgcacctggtggctgttcgctgagggttaaagacaaaggcgctgtgctggaatcaagcatccgatgcattatcaaatgcaacgccatttccaagcctcccactcaagactacagcgatgtgcttcaaagtggagtgccacttctaaagtggcagcagtttgtggaggagggcatagaatcagaaactgctgcccaggtgtcggtttgggaagagatagaggagcgagtgaagtggataaagtcaatgctgagttcaatggacgacggtgacataagcatctcagcttatgacacggcttgggtggctctaataccaaaagttacggaggagggagtgaagagtccgcagttcccttcttcccttgagtggatagccaacaatcaactcccggatgggtcatggggcgacgcccagatattctcaccccacgatcgcatcattaacacattggcttctctggtcgccttgaagtcttggaatcttcatccccaaaacacacggaaaggagtagccttcttcaaccaaaacatttggaagctggaagaggagaatgcggagcacatgccgatcgggttcgagattgctttcccttccctactcgaatttgccaagaaactaaagctgggaatccggagcgactccccggcgttgcaacagattaatgcccgcaggcgcctaaagcttgcgaggataccaaaggacataatgcacaaactgccaaccacgctattgcacagcttggaaggcatgagtggtttggattgggaaaagcttctaaaattgcaatctcaagacggctccttcttgagctccccagcctccactgccttcgctctcatgcacaccaaccacccaaattgcttcaaatatttggaagcatcggtgcaccgctttaatggtggagtacccaacgtgtaccctgtggacctgttcgaacacatttgggctgtggacagattgcaacgacttggaatttctcgattctttcacccacacattgttgagtgtgtgaataatgtgcgcacacactggagtgaaaaaggaatatgctgggccagaaattcggagtttcgcgacattgatgacacggccatgggattcagactgctcagactgtacggccacgatgtttcggcggaggtgtttaagcatttcgagaaagatggggagttcgtgtgcatagcgggccagtcaacgcaggcggtcaccggaatgttaaacttgtaccgagcttcggatcaggtaatgtttccgggggagaaaattctagaggacgccaaacaatttgcctccaagttcctcaggcagaaacaggccgccaatcagctcttagacaagtggatcatcgccaaggacttgcctggagaggttggttacgctcttgacgttccatggtttgcaagcttgcctcgggttgagacccgtctctacatacagcactatggtggcaaaaatgacgtctggattggaaaaactctctacaggatgttcaaggtcaacaacgatacatacttggagcttgcaaaattggactacaacaactgccaaagattgcatcagattgagtgggttgatattcaaaaatggtacacagaaagcaagctgcgagattatggaatgaggagaagcagcattttgttctcatattttggtgcagtgtgtagcattttcgaaccagaaagggccaaggagaggcttgcatggaccaaaactgctgctttggtccacaccattgcatcccattacaaggatgccaatgcccaccaacgacgagcctttctccaacaatttaccaactttcatgctgctcagccatacgataataatgcatggagatcaggcaatatgcagcagaagggaggagaaggactagttgggattttgctgcgaactctaacaaatatctcgttggatatactgttgtcgcacggcgtcgacatcacccaccatttgcaccaagcttggcaaaaatgggtgtttaagtggcaagaggatggagatgtgcacaaggaagaggcagagttattggtgcagacaataattctcaactcaggctgttcaactttggaggatctgttgtccaattctcagtttcagaagctttccaacctcacaaacaaagtgtgccatcaacttgctcactttaaaaagcataaggtaaataacggtaacctctataaggagaaaacagacaacaaaatgcccccagagatagaagaagacataaggaaacttgtgcagctggtgatccaaaaatcttcagatggcaatgacattgactcaccgattaagcaaacatttctaacagtagcaaaaagtgtgtactatgcagcttatttcgatgcttggactatcaactaccacatagccaaggtcctatttgaaagagtgttctaatcctagctacccacacacccatgttgtatttgtattgtcaaattttgtatattcttcaccacatgggacacaaaaactttggtctgtgtttcttctgtcaataaaaagacatcatctttaaaacccaaaaaaaaaaaaaaaaaaaaaaaaaaa

SEQ ID NO: 579 - DNA, 2658 bp, Cucurbita maxima
  ent-kaurene synthase B
gaaagcggtagttttcggctcttggctgtttttgtgtactgcctattctgttctttatatgcactgaatgtgaaaatgcctcaccagagtttgatgctgcttccgcaatttctttgcatgtcctaaacataccagtcatgtatctttcccgacctaccggcgttgcccgttttgctgcctcctcctcctcctcctcctcagcttccctattccctggagtggatgtggacacaacaactaaaactggagctttgcactttgaagaaacaaaagaaagaattaagaaattgttcgacaaggttgaactttcagtttctgcatatgatactgcatgggtggcaatggttccttctccaaactctctcaaccaacctcttttccccgagtgtataaactgggtattagatagtcaacatgctgatggctcatggggcctactccacaacgatcagttgctgatgaaggccaatctcttatctacattagcatgtgttcttactcttaagcggtggaatattgggcatgatcatatgagcaaggcccttgattttatcaagtctaatatagcttcagctactgatgagaaccaacgttctccggtgggatttgacattattttccctggcatgattgagtatgctaaagacttgaatttgaatctacccttggcaccgacgaacgtggatgccttggttcgaaagaaagagttggagctgagaagctgcagaagcaactctgaaggtggaaaagcctatttagcgtatgtttcagaaggaattggaaagttacaggactgggatatggtcatgcaatatcaaaggaagaatggatcactgtttaattctccatccactacggcagcggcttttatgcatagaaatgatgatggctgttttgattatcttcgctcactcttacaaaagtttgatggctcagttcccacaatatatcctcttgatatatatgctcgattacacatggttgatagccttcaaaaattcggaattgctcggcatttcaaagaggagattagaagcgtattagatgaaacttacaggtgttggatgcaaggagaggaaaatatattcttagatgcttcaacttgtgcaatggcctttcgaatgttacgtgttgaaggatatgatgtttcttcagaccagttgactcaattttcagaagatatctttcccaattgccttggaggatatttaaaagacttcggtgcctcgctggagttatataaggcctctcagattatcacgcaccccgatgaatctgttctggaaaatataaactcttggactagtcgtttcctgaagcatggattatctagtgattcagtttggtctgatagaaccgatagtgttgttaaacaagaggctgttaatgctcttgagttcccctataatgcaactctagaacgcctaataagtaagagggcaatggaaagttacagtggagacattgtgaggatttcaaaatcgccatatgcctgcttaaattttggccatcaagattttctggaacttgctgtagaggatttcaataccctgcaacgcattcatcttaaagaactggaagagcttcaaagatgggtggttgaaaacaaattggacgagttgaaatttttcagactgcacctagggtactgctattttgctgcggcagcgacccttactgatcctgaacttcatgatgctcgcatagcatgggcacaaaatggtgtgctcacgaccgtggttgatgatttctatgatggtggaggatctgaagaggaattggataaccttatagaattggtggaaaagtgggatcctgatggggaagtgggttactgttccaaggacgttgagattgtatttcttgcactgcacagcacagtttgtgaaataggaagaagagctttagtatggcaaggacgcagtgttatgaggaatgttatcgatggttggttggctctgctgaaggtgatgagaaaggaagctgaatggtcgacaaataaggtagtgccatcaatgggtgaatatatggaacaagcccatgtatcattcgcgttgggacctataatccttccaatgctcttctttgttggacctaaactctcagaggaaatgattggaagctgtgaataccagaagttatataagctgatgagcactgctggtcgccttaagaatgatattcgatcttacgatagagaatgcaaagagggaaagctgaatattctgtctctgtggatgattgatggcggtggtaatgtcaccaaagaggaggccattgaagcaattaaaggggattttgagagggcgataagagagctgctggggttagttttgcaggagaacactacaattccaagagcttgtaaggatttgttctggaaattgatgtccattgtgaatctattttacatggaagatgatgggtacacttcaaataggttgatgaacactgtaaaagccatgtttgaacaacccatggatctggatgcactattgaacaaatgaacgaacaacaaacgaaataagttgtagtgggaagcagacgccacctattcactgtcttctctactgatcagatgtctattgctttctcattgaggaaatggcaaataaaacattttatggaaacatttcattgttaaattgagacagtctg

SEQ ID NO: 580 - DNA, 1976 bp, Elaeis oleifera
  sesquiterpene synthase
atccaagatcttcacttactagttctattctatatgtccagcaacacgatggaagctcatggatctacaaaccattcttcagtgccatgcggtggtgatggaaccattcgcttccttgcaaattttcaccctaccatttggggcgattacttcattgaaaattatccattaccttcgaatcttcagaagtcagaggcatgtattgaaaaaaggagggaagagttaaaagtggaagtaatgaacttgcttaaaaatgctaatgattacttacaagagatggaattaattgatatacttcaacgtctgggtgtggcatatcactttgaaaagaaaatagatgagatactaagccaaatttttaaagagcatatggaggatgataatttgcatgctgttgcccttcgctttcgactcttgagacaacatggctacaatatgcctacaaatatttttatcaagttcaaagaagtcgatggaagtttcaaggctaccttaagaaatgatgtgaagggtctgttaagtctatatgaagctgcttatcttggtatcccaaaagataatctattagatgaagcactgaattttgcaaaattacatctcaagtccatggaaagccatatgaaaacccctcttgcagtacgagtactagatgcctttgagatgcctttacatagaagaacgacgaggttagaggcaaagaattatatctccatttaccaacaagatgatggacggattaatgtggtactagagcttgcaaagttggattttcatatactgcaatcaattcatagagaagaagttaggagcatctctatgtggtggaaagcactcggccttgcaaaaaaactaaccttttgcagggatagagtagtcgagggttatttttggattcttggagtatattttgagcctcaatattctagagcacgaatttatctgacaaaggtgcttgctttactttcaatcatggatgatatctatgatacttatggcatagcagaggaactccaagcatttactgaagtcatccgaaggtgggacatagaggcagtggatcagctagatgaggtctataaactctatttccttaatctatataacacattcaaggaatttgaggatgagctcgcaaaggaaggaaactcctatagggtggaatatcttaaagaatcagtcaaagaattatcaagggcttatcttgaagaagttaaatggagggacgaaggttacgtgccgcctcttaaagaatatctgaatgtttcacagatctccactgtccatgttgcattatcctgtgcttcttttgttggcatgggagaagaagcaacaaaagaggcattcgattgggttacaagcttcccaagaatcataaagtctagttgcttaatcggccggctcttggatgatgttgcatccaatgagtttgaacatgagaggaagcatgtctcgtcggcagtccattgctacatcaaagagcatggcacttcagtgcaagaggcatatgagaagctacggggaatgattgaagacgaatggaaaattatgaatcaagagtatctatgtatgactaccatgccaatgtctttgatcaggccaatcatcaacctcccacggatggcagaaaccgtatacaagaagtgtgattcatacacgcactctttatctacgatgaaagattatatcatgtcgttgctggtcgagcccatttcgttctgagaaggctatattaaagatcatgtcagctttcttataggttcgcctatctatctactacattgttgttttggattttcctattgttggtcattcttgtgcgagggagactaagtggtgtgcttccatatctattcttggtaccttatagtgtgtgtaatcctctaaaacacattgtcattgtcatatgagcgagttagttcttgataaagttgtatgactttattatttaatcatcttgactatggcaacaactcaac

SEQ ID NO: 581 - DNA, 3103 bp, Giberella fujikuroi
  (-)-copalyl diphosphate/(-)-ent-kaurene synthase
caactgctttcttctctcatcaacacaaatttgaagtttgtcactgtagtggatctggaatacttacacaagatgcctggcaaaatcgagaacggcacccccaaagacctcaagacaggaaatgactttgtatcagcagcaaagtcgctgctggaccgcgccttcaagagccatcatagctactatggtctatgttccaccagctgtcaggtatatgacactgcttgggtggccatgatacccaagacgagagacaatgtcaagcaatggctgtttcctgagtgcttccactatcttctgaagactcaggccgctgatggtagttggggtagtctccccacgacccagactgctggtattctagacactgcttcagctgtgcttgcactcttatgtcacgcacaagagcctctgcagatactggacgtctcgccagacgagatgggtctcaggatcgagcacggggtaacttctttgaagcgacagctagctgtttggaacgatgttgaagataccaatcacattggtgtcgagtttattattccagctttactttccatgcttgagaaagagctcgacgtgccatcttttgagtttccttgcagaagtatcttggagaggatgcacggagagaagctcggccatttcgatttggagcaagtatatggcaagccgtcttcactacttcactcccttgaagcctttcttggaaagcttgactttgatcgcctttctcaccatctttatcatggctctatgatggcttcaccttcttccactgcagcctacctcattggtgcaaccaagtgggacgacgaggctgaagattacctgaggcacgttatgagaaatggtgctggtcacgggaatggtggcatctcaggcacctttcctacaacacattttgagtgtagctggatcatagcgacactcctgaaggttggcttcactttgaaacaaatcgatggtgatggcttgcgcggcttgtcaactatacttctcgaagcgttgagggacgagaatggagtaattggctttgcaccccgtactgctgatgttgatgacactgcaaaagctcttctggcattgagccttgtcaatcaacctgtcagcccagatatcatgatcaaggtctttgaaggaaaagatcacttcaccacgttcggatctgaacgtgatcccagcttgacttccaacctccatgtgctgctgagtctcctgaagcagtccaatctatcgcaataccacccacaaatcctgaagaccacgttgttcacttgccgatggtggtggggcagcgaccattgcgtcaaagataaatggaatttgagtcatctatacccaaccatgcttctggtggaagctttcaccgaggtacttcatctcattgatggtggcgagctttctagtctctttgacgagagcttcaagtgcaagatcggcctgtcaatcttccaggctgtactacgtatcatcctcacccaagataacgacggatcttggagaggatatcgcgagcaaacatgctacgccattctagctcttgtacaggcacgccatgtatgtttcttcactcacatggtggacaggctacagagttgcgtcgaccgtggcttttcgtggctcaagtcctgcagctttcattctcaggacctcacttggacgtcaaagacagcatatgaggttgggtttgttgctgaagcgtacaagctagcagcccttcagtcagcaagcctagaggtgcccgccgctactattggccacagcgtcacctcggcggttccatcatcggacttggagaagtacatgaggcttgtgcgcaagactgctttgttctcgccactggacgagtggggactcatggcgtcaatcattgagtcctcgttcttcgtgccccttctacaagctcagcgcgttgagatttatccgagggacaacatcaaggtcgacgaggacaaatacctgagcatcattccttttacttgggtcggatgcaacaacagatcccgcacatttgcatctaacagatggctctacgatatgatgtacctgtccctcctgggctaccagaccgatgagtacatggaagctgtcgctgggccggtattcggtgatgtctctctgcttcaccagaccatcgacaaggtcatagacaacacaatgggaaacttagccagggccaatggtaccgtgcacagtggcaatggtcatcagcatgagtcacccaacattggacaagttgaggatactctcactcgcttcaccaacagcgtgctcaaccacaaagatgttctgaattcaagctcttctgaccaagacactcttcgccgagaattcagaacgttcatgcatgcccatatcacacagatagaggacaacagtcgcttctccaagcaggcctccagcgacgctttctcttccccagaacaatcgtacttccaatgggtcaacagtacaggaggcagtcacgtcgcctgcgcgtactcattcgctttctccaactgcctaatgtcagcgaatctgctccaaggcaaggacgcatttccctccggcactcagaaatatctcatttcatccgttatgcgtcacgctacaaatatgtgtcgtatgtacaacgactttgggtccatagctcgcgataacgctgagcggaatgtgaactcgatccacttccccgagttcacgttatgtaacggaacgtcacagaatctcgatgaaaggaaagagagacttttaaagatagctacgtatgagcaaggttatcttgatcgtgctctcgaagctctggaacgacagtctcgtgatgatgcaggtgatcgtgctgggtctaaggatatgaggaagctcaagattgtaaaactgttctgtgatgtcaccgacttgtatgatcagctttacgtgatcaaggacctttcaagcagcatgaagtgagggaatactatggagctggtaattttgatatgtattttcctctagtttatttgaagacacatagtttcagtaagtgctcacaagactgcaaacccatcaaagcttggtccgtctgatatggagcatcggatacatggtttgcactcccgcaaagaaattcaacactcggcct

SEQ ID NO: 582 - DNA, 2705 bp, Ginkgo biloba
  levopimaradiene synthase
atatttgcctaaacctgcacaaatggctggggtgctctttgcaaatctgccttgctcactgcaactctctccaaaagttcccttccggcaatccactaatattcttattccttttcacaagagatcctcatttggatttaatgcacagcactgcgtccgttctcacttaaggctgagatggaattgtgtcgggattcatgcctcagctgcagagactcgtccagatcagcttccacaggaggaacgctttgtgtcgagacttaatgcggattatcatccagctgtctggaaggacgatttcatcgactctctaacatcccctaattcccacgcgacatcgaaatcaagcgtcgatgagacaatcaataaaagaatccagacattggtgaaggaaatccagtgcatgtttcagtccatgggcgacggtgaaacgaatccatctgcatatgatacagcttgggtggcaagaattccgtcaattgacggctctggtgcaccccaatttccccaaacgcttcaatggattctgaacaatcaactgccagatggctcgtggggtgaggagtgcatttttctggcgtatgacagagttttaaacactctcgcctgcctcctcactctcaaaatatggaataagggcgacattcaagtgcagaaaggggttgagtttgtgagaaaacacatggaagaaatgaaggacgaagctgacaatcacaggccaagtggattcgaggtcgtgtttcctgcaatgttagatgaagcaaaaagcttgggattggatcttccttatcacctccctttcatctcccaaatccaccaaaagcgccagaaaaagcttcaaaagattcccctcaatgttcttcataaccatcagacggcgttgctctactctctggagggtttgcaagatgtggtggactggcaagagatcacaaatcttcaatcaagagacggatcatttttaagctcccctgcatctactgcttgtgtcttcatgcacactcaaaacaaacgatgcctccactttctcaacttcgtgctcagcaaatttggcgactacgttccttgccattacccacttgatctatttgaacgcctctgggctgtcgatacagttgaacgcttgggaatcgatcgctatttcaagaaagaaatcaaagaatctctggattacgtttataggtactgggacgccgaaagaggcgtgggatgggcaagatgcaatcctattcctgatgtcgatgacactgccatgggtcttagaatcctgagacttcatggatacaatgtatcttcagatgttctggagaatttcagagacgagaaaggagacttcttttgctttgccggtcaaacgcaaattggtgtgaccgataatcttaacctttatagatgttcacaagtatgttttccgggagaaaagataatggaagaagctaagaccttcactacaaatcatctccaaaatgctcttgccaaaaacaacgcatttgataagtgggctgtcaagaaggatcttcctggagaggtggagtatgctataaagtatccgtggcatagaagtatgccaagattggaggcaagaagttacatagagcaatttggatcaaatgatgtctggctggggaagactgtgtataagatgctatatgtgagcaacgaaaaatatttggagctggccaaattggacttcaatatggtgcaggccttacaccaaaaggagactcaacacattgtcagctggtggagagaatcgggattcaatgatcttacattcacccgccagcggcctgtggaaatgtatttctcagtggcggttagtatgtttgagccagaattcgctgcttgtagaattgcctatgccaagacttcttgcctcgcagttattctagacgatctttacgacacccacggatctctggatgatcttaaattgttctctgaagcggtccgaagatgggatatctctgtgctggatagcgttcgggataatcagttgaaagtttgcttcctagggctgtacaacacagtgaatggatttggaaaagatggactcaaggaacaaggccgtgatgtgctgggctatcttcgaaaagtatgggagggcttgctcgcatcgtataccaaagaagccgaatggtcggcagcaaagtatgtgccgacattcaacgaatatgtggaaaatgccaaagtgtccatagcacttgcgacagtcgtactaaactcaatctttttcactggagaattacttcctgattacattttacagcaagtagaccttcggtccaaatttctgcatcttgtgtctttgactggacgactaatcaatgacaccaagacttaccaggccgagagaaaccgtggtgaattggtttccagcgtacagtgctacatgagggaaaatccggagtgcacagaggaagaagctctaagtcatgtttatggtatcatcgacaacgcactgaaggaattgaattgggagttggccaacccagcgagcaatgccccattgtgtgtgagaagactgctgttcaacactgcaagagtgatgcagctgttttatatgtacagagatggctttggtatctctgacaaagagatgaaagaccatgtcagccgaactcttttcgatcctgtggcgtagcatactgatattatatataatattcatattcaatccaaaaaaaaaaaaaaaaaaaaaaaaa

SEQ ID NO: 583 - DNA, 3950 bp, Gossypium arboreum
  (+)-delta-cadinene synthase
aatttaacttttattaatttaaaatttaaagatttcaaaggggttctaaaatggaaatttttcgattttaagggaattgtgccagcccctagtttcgcccttgtttgtagtgctttattttaaaaaagtaaatataatagaatatgtatatatatatatatataaaccaaagtgaaagatgaaaatttatataaatgatcgctgcaagcttcaagctcacaataatatgattctttaccatcaagaaacattggtgctttatacagagaaaagaaaaactttggtcctcctcgtagctaatattttaacaatttaatttttatataataaatttttaacaattatttcatattttttaaatatattcatgttgaatgtagcagtatatagttatattagttatgctcataaattttggatgcattagattttccttatgtaatttgataacaatgattattatttttacttctaacaaataattaaatatttttttgttgattcgataaatatcattattttttaaatgatttaaaatataaaaataataatagattcgaccgaacgctcaccctattgagtgagtatatcaattattagaatttaattaaaaaaggaaaccaaatatagccggcttaattttgtttaatattaatttatgtgtggaaattcacttaaaaacagagtccatggctgctaacatattatatattaaaccatttcctattaataaatttatgaacgagagttacatccttctaaattcattttacttagaggcggagtataatattttatgtagtagttattcttttactatataaataaataaataaaattttaatcgcctgtgtattatgattgattcagctgaatcaaagttggaataatattttaatttgggatcccaattaattgagattggtttgattttgggttgtaaatattttttattaattttagataaattattggaagttggagtcaaaattgaccgtctcagctaattatacaaataataataatatagagaaatgggtatattgctcaacactcacatttactacgtcagcaatagtcagacagactgctaagtaaacaatgtacactcaattcgagtcaaacaaatcctttatcccaagattctaaaataatgtgtttgaggcaccaattttgaaggatagaaagtggaaacaaacaaaaggatattaaaaaacaaggaaatttctcactgtatttgcatatttttctccttccagtataattaaaatacgtgcaatttacgttgtactttgttgactcctatcttatacctataaatacatgcaacaattgcacacatcgtctcatccaaaacctgtgttttaaacactaaacagtaagcaaaggcagcaaattaatctttgaattatttgcttccaaaaccctacacttttccttcaacacatcctagaaaatggcttcacaagcttctcaagttcttgcttcaccccatcccgccatttcatccgaaaatcgacccaaggctgattttcatcccggtatttggggtgatatgttcatcatctgtcctgatacggtaatctataatttttttcttactttctcttttatcgatttttaagttttttggagatttcatggaaaagcattatacgtacttgagcaggatatcgatgctgcaactgaattacaatatgaagaattaaaagcacaagtgaggaagatgattatggaacctgttgatgattcaaaccaaaagttgcccttcattgatgctgttcaaagattaggtgtgagttatcattttgagaaagagattgaagatgaactagagaatatttaccgtgacaccaacaacaatgatgcggacaccgatctctacactacagctcttcgattccggttacttagagagcatggcttcgatatttcttgtggtaattaagtcttaaactttcataactcttcttatccatttatcaattaatattatcaaactttacattaataatcatctgtacaatacttcaatatatatatatttattgatgaaactaatgtttgatgatgattttgggtgcttgaccagatgcattcaacaagttcaaagatgaggcagggaacttcaaggcatcattgacaagtgatgtgcaagggttgttggaactttatgaagcttcctatatgagggtccatggggaagatatacttgatgaagccatttctttcaccactgctcaacttacacttgctctaccaactttacaccatcctttatcggaacaggtcggccatgccttaaagcagtctatccgaaggggcttgccaagggttgaggcccggaatttcatttcgatataccaagatttagaatcccataacaaatcgttgcttcaatttgcaaagattgatttcaacttgttgcagcttttgcataggaaagagctaagtgagatctgcaggtaagtgtttggagatctttaaagctatgaagtctaatactatttcaattgatcacacgactgttgctgacattttatgatgctttttttaggtggtggaaagatttagactttacaagaaaactaccatttgcaagagatagagtggttgaaggctatttttggataatgggagtttactttgaaccccaatactctcttggtagaaagatgttgacaaaagtcatagcaatggcttccattgttgatgatacttatgattcatatgcaacctatgatgaactcattccctatacaaatgcaattgaaggtgagattttttttcctttcctccaaaaaaaaaaaaagtttttgagatcccccaagaataggggaaaatatatgtttttaaacgttaggatattcactccaacttgcagttgctcatattttaatggtgatagtatgaactaaccaggctaagttttagattcaaattaaccctgaaattgtgttttaggtgggatattaaatgcatgaaccaactcccgaattacatgaaaataagctacaaggcactattagatgtttatgaagaaatggaacagctgttggcaaatcaagggagacagtaccgagttgagtatgcgaaaaaggcggtatgtaatgatacaatagtatgatatgctttaatcataaacgtataaaatttgaaaattacattagcaatttgcttacttttttatgcctttaatcctcagatgatacgtcttgttcaagcttaccttttggaggccaaatggactcatcaaaattataaaccaacctttgaggaatttagagataatgcattgccaacctctggctatgccatgcttgctataacggcgtttgtcggcatgggcgaagttataacccctgagaccttcaaatgggccgccagtgaccccaagatcattaaggcttccaccattatttgcaggttcatggacgatattgctgaacataaggtatactatatattcatattcaagaattctaaaaatcgattatggtatatatatgcacttaaatctatatcatagaattgtaaggcttctagggtttgcatttgctaagttaattaatatacatggttcatatgggtgcagttcaaccataggagagaagacgattgctcagcgatcgaatgttacatgaaacaatatggggtgacagcgcaggaagcatacaatgaattcaacaaacacattgagagttcatggaaagatgtaaatgaagagttcttgaaaccgacagaaatgccgacacccgttctttgtcgtagcctcaaccttgctagggttatggatgtactttacagagaaggtgacggttatacacatgttgggaaagctgctaaaggtgggatcacttcattattgattgatccaatacaaatttgaaattcaacattggcttaagatttactatgagataaaattaataaggtttgtacaatgaagg

SEQ ID NO: 584 - DNA, 1883 bp, Gossypium arboreum
  (+)-delta-cadinene synthase
ctaaacagtaagcaaaggcagcaaattaatctttgaattatttgcttccaaaaccctacacttttccttcaacacatcctagaaaatggcttcacaagcttctcaagttcttgcttcaccccatcccgccatttcatccgaaaatcgacccaaggctgattttcatcccggtatttggggtgatatgttcatcatctgtcctgatacggatatcgatgctgcaactgaattacaatatgaagaattaaaagcacaagtgaggaagatgattatggaacctgttgatgattcaaaccaaaagttgcccttcattgatgctgttcaaagattaggtgtgagttatcattttgagaaagagattgaagatgaactagagaatatttaccgtgacaccaacaacaatgatgcggacaccgatctctacactacagctcttcgattccggttacttagagagcatggcttcgatatttcttgtgatgcattcaacaagttcaaagatgaggcagggaacttcaaggcatcattgacaagtgatgtgcaagggttgttggaactttatgaagcttcctatatgagggtccatggggaagatatactcgatgaagccatttctttcaccactgctcaacttacacttgctctaccaactttacaccatcctttatcggaacaggtcggccatgccttaaagcagtctatccgaaggggcttgccaagggttgaggcccggaatttcatttcgatataccaagatttagaatcccataacaaatcgttgcttcaatttgcaaagattgatttcaacttgttgcagcttttgcataggaaagagctaagtgagatctgcaggtggtggaaagatttagactttacaagaaaactaccatttgcaagagatagagtggttgaaggctatttttggataatgggagtttactttgaaccccaatactctcttggtagaaagatgttgacaaaagtcatagcaatggcttccattgttgatgatacttatgattcatatgcaacctatgatgaactcattccctatacaaatgcaattgaaaggtgggatattaaatgcatgaaccaactcccgaattacatgaaaataagctacaaggcactattaaatgtttatgaagaaatggaacagctgttggcaaatcaagggagacagtaccgagttgagtatgcgaaaaaggcgatgatacgtcttgttcaagcttaccttttggaggccaaatggactcatcaaaattataaaccaacctttgaggaatttagagataatgcattgccaacctctggctatgccatgcttgctataacggcgtttgtcggcatgggcgaagttataacccctgagaccttcaaatgggccgccagtgaccccaagatcattaaggcttccaccattatttgcaggttcatggacgatattgctgaacataagttcaaccataggagagaagacgattgctcagcaatcgaatgttacatgaaacaatatggggtgacagcgcaggaagcatacaatgaattcaacaaacacattgagagttcatggaaagatgtaaatgaagagttcttgaaaccgacagaaatgccgacacccgttctttgtcgtagcctcaaccttgctagggttatggatgtactttacagagaaggtgatggttatacacatgttgggaaagctgctaaaggtgggatcacttcattattgattgatccaatacaaatttgaaattcaacattggcttaagatttactatgagataaaattaataaggtttgtacaatgaaggaaatgtataatttcattacattatttgatttgtttcttctatacaaaagaatgaacaagcggataatct

SEQ ID NO: 585 - DNA, 1890 bp, Gossypium arboreum
  (+)-delta-cadinene synthase isozyme C2
gagcaaaccaagaaaaggctgcaaattcagcttctcaatatctgcttttgatcaatcgaaatggcttcacaagtttctcaaatgccttcttcatcacccctttcttccaataaggatgaaatccgtcccaaagccgattttcagcctagcatttggggagatttcttcctcaattgtcccgacaagaatattgatgctggaactgaaaaacgccaccaacaattgaaagaagaagtgaggaagatgattgtggcaccaatggctaattcgacccaaaagttagccttcattgattcagtccaaagactgggtgtgagttaccatttcaccaaggagatcgaagatgaactagagaatatctaccataacaacaatgatgccgagaacgacctctacactacatctcttcgattccgactactccgagagcatggatacaatgtttcatgcgacgtattcaacaagtttaaagacgagcaagggaatttcaagtcatccgtgacaagcgatgttcaaggattgttggaactttaccaagcttcctatttgagggttcatggggaagatatattggatgaagcaatttctttcaccaccaaccatttaagccttgcagtatcatctttggaccatcctttgtccgaagaggtttctcatgctttgaaacaatcaattcgaagaggcttgccaagggttgaggcaaggcactatctttcagtataccaagatattgagtcccacaataaggctttgttggagtttgctaagatcgacttcaacatgttacaatttttgcataggaaagagctaagcgagatttgtaggtggtggaaagatttagactttcaaagaaagttgccatatgcaagagatagagtggttgaaggctatttttggatctcaggagtgtactttgagccccaatattcacttggtagaaagatgttgacaaaagtgatagcaatggcatctattgtagatgatacatatgactcatatgcaacatatgaagagctcattccatatacaaatgcaattgagaggtgggatatcaaatgcatagatgaacttcctgaatacatgaagccgagctacaaggcactattagatgtttataaagaaatggaacaactggtggctgagcatgggagacaatatcgtgtcgaatatgcgaaaaatgcgatgatacgacttgctcaatcttatcttgtggaggccagatggactcttcaaaactacaaaccatcattcgaagagtttaaggctaatgcattgccaacttgtggttatgccatgcttgctattacatctttcgtcggcatgggagatatcgtaacaccagagacctttaaatgggcagccaatgaccctaagatcattcaagcttccacaattatttgtaggtttatggatgatgttgcggaacacaagtttaagcataggagagaagatgattgctcagcaatagagtgttacatggaagaatatggcgtatcagcacaagaggcatacgatgtattcaacaagcatgttgagagtgcctggaaggatgtgaatcaagagtttcagaaaccaacagaaatgccaacagaagttttaaatcgtagcctaaaccttgcaagggtgatggatgtactttacagggaaggagatggatatacatatgttggaaaagcggctaagggtggaatcacttcattgcttattgaaccaattgcactttgaaatttatattaaattttcctcttcaagcatcttccttaagaaatagttattaagttctaattaataatgttgtataatattcatatatattatcaaagaaagtccgaatcgattgtctttgtactcattaccttctattaattcaataaagttcttttcaagctt

SEQ ID NO: 586 - DNA, 1892 bp, Gossypium arboreum
  (+)-delta-cadinene synthase isozyme XC1
ccaaatttcaagagcaaaccaaaaaaaggctgcaaattcagcttttcaatatttgcttttgatcaatcgaaatggcttcacaagtttctcaaatgccttcttcatcacccctttcttccaataaggatgaaatgcgtcccaaagccgattttcagcctagcatttggggagatctcttcctcaattgtcccgacaagaatattgatgctgaaactgaaaagcgccaccaacaattgaaagaagaagtgaggaagatgattgtggcaccaatggctaattcaacccaaaagttagccttcattgattcagtccaaagactgggtgtgagttaccatttcaccaaggagatcgaagatgaactagagaatatctaccataacaacaatgatgccgagaacgacctctacaccacatccattcgattccgactactccgagagcatggatacaatgtttcatgcgacgtattcaacaagtttaaagatgagcaagggaatttcaagtcatccgtgacaagcgatgttcgaggattgttggaactttaccaagcttcttatttgagggttcatggggaagatatattggatgaagcaatttctttcaccacccaccatttaagccttgcagtagcatctttggaccatcctttgtccgaagaggtttctcatgctttgaaacaatcaattcgaagaggcttgcccagggttgaggcaaggcactatctttcagtataccaagatattgagtcccataataaggctttgttggagtttgctaagatcgatttcaacatgttacaatttttgcataggaaagagctaagtgagatttgtaggtggtggaaggatttagactttcaaagaaagttgccatatgcaagagatagagttgttgaaggttacttttggatctctggagtgtactttgagccccaatattcacttggtagaaagatgttgacaaaagtgatagcaatggcatccattgtagatgatacatatgactcatatgcaacatatgaagagctcattccctatacaaatgcaattgagaggtgggatatcaaatgtatagatgaaattcccgaatacatgaaaccaagctacaaggctctattagatgtttatgaagaaatggtacaattggtggctgagcatgggagacaatatcgtgtcgagtatgcgaagaatgcgatgatacgacttgctcaatcttatcttgtggaggccaaatggactcttcaaaactataaaccatcattcgaggagtttaaggctaatgcattgccaacttgtggttatgccatgcttgctattacatctttcgtcggcatgggagatatcgtaacaccagagacctttaaatgggcagctagtgaccctaagatcattcaagcgtccacaattatttgtaggtttatggatgatgttgctgaacacaagttcaagcataggagagaagacgattgctcagcaatcgagtgttacatggaagaatatggcgtaacagcacaagaggcatatgatgtattcaacaagcatgttgagagtgcttggaaggatttaaatcaagagtttttgaaaccaacagaaatgccaacagaggttttgaatcgtagcctaaaccttgcaagggtgatggatgtgctttacagggaaggcgatggctatacatatgttggaaaagcggcaaagggtggaatcacttcattgctcattgaaccaattgcactttgaaattatgttaatttttcctctccaagcttgtttcttaagaaatagttattaagttctaattaataatgttttataatattcatatattataaaagaaagtccaaatcgattgtctttgtacttattgccttatattaattcaataaggttctttcc

SEQ ID NO: 587 - DNA, 1893 bp, Gossypium arboreum
  (+)-delta-cadinene synthase isozyme XC14
ccaaatttcaagagcaaaccaaaaaaaggcagcaaattaagcttttcaatatttgcttttgatcaatcgaaatggcttcacaagtttctcaaatgccttcttcatcacccctttcttccaataaggatgaaatgcgtcccaaagccgattttcagcctagcatttggggagatctcttcctcaactgtcccgacaagaatattgatgctgaaactgaaaagcgccaccaacaattgaaagaagaagtaaggaagatgattgtggcaccaatggctaattcaacccaaaagttagccttcattgattcagtccaaaggctgggtgtgagttaccatttcactaaggagatcgaagatgaactagagaatatctaccataacaacaatgatgccgagaacgacctctacaccacatcccttcgattccgattactccgagagcatggattcaatgtttcatgcgacgtattcaacaagtttaaagacgagcaagggaatttcaagtcatccgtgacaagcgatgttcgaggattgttggaactttaccaagcttcctatttgagggttcatggggaagatatattggatgaagcaatttctttcaccaccaaccatttaagccttgcagtagcatctttggactatccgttatccgaagaggtttcacatgctttgaaacaatcaattcgaagaggcttgccaagggttgaggcaagacactatctttcagtataccaagatattgagtcccataataaggttttgttggagtttgctaagatcgatttcaacatggtacaacttttgcataggaaagagctaagtgagatttctaggtggtggaaggatttagactttcaaagaaagttgccatacgcaagagatagagttgttgaaggctatttttggatctcaggagtgtactttgagccccaatattctcttggtagaaagatgttgacaaaagtgatagcaatggcttctattgtagatgatacatatgactcatatgcaacatatgaagagctcattccctatacaaaagcaattgagaggtgggatatcaaatgcatagatgaacttcctgaatacatgaaaccaagctacaaagcgctattagatgtttatgaagaaatggaacaattggtggctaagcatgggagacaatatcgtgtcgaatatgcgaaaaatgcgatgatacgacttgctcaatcttatcttgtggaggccagatggactcttcaaaactacaaaccatcatttgaggagtttaaggctaatgcattgccaacttgtggttatgccatgcttgctattacatctttcgtcggcatgggagatattgtaacaccagaaacctttaaatgggcagccaatgaccctaagatcattcaagcttccacaattatttgtaggtttatggatgatgttgctgaacacaagttcaaacataggagagaagacgattgctcagcaattgagtgttacatggaagaatatggcgtaacagcacaagaggcatatgatgtattcaacaagcatgttgaaagtgcttggaaggatgtgaataaagagttcctgaaaccaacagaaatgccaacagaagttttgaatcgtagcctaaaccttgcaagggtgatggatgtactttacagagaaggtgatggctacacatatgttggaaaagctgctaagggtggaatcacttcattactcattgaaccagttgcactttgaaatcatgttaaattttcctcttctgttccttaaggaatagttattaagttataattaataatgttttataatattcatatattataaaagaaagttcaaatcaactgtctttgtattcatttccttgtattgatccaataaagttcttttcaagctt

SEQ ID NO: 588 - DNA, 1892 bp, Gossypium arboreum; identical to SEQ ID NO: 586
  (+)-delta-cadinene synthase

SEQ ID NO: 589 - DNA, 1851 bp, Gossypium hirsutum
  (+)-delta-cadinene synthase
ttttcaatatttgcttttaatcaatcgaaatggcttcacaagtttctcaaatgccttcttcatcacccctttcttccaataaggatgaaatgcgtcccaaagccgattttcagcctagcatttggggagatttcttcctcaattgtcccgacaagaatattgatgctgaaactcaaaaacgccaccaacaattgaaagaagaagtgaggaagatgattgtggcaccaatggctaattcaaccctaaagttagccttcattgattcagtccagggactgggtgtgagttaccatttcaccaaggagatcgaagatgaactagagaatatctaccataacaacaatgatgccgagaacgacctctacaccacatcccttcgattccgactactccgagagcatggattccatgtttcatgcgacgtattcaacaagtttaaagacgagcaagggaatttcaagtcatccgtgacaagcgatgttcgaggattgttggaactttaccaagcttcctatttgagggttcatggggaagatatattggatgaagcaatttctttcaccagcaaccatttaagccttgcagtagcatctttggaccatcctttatccgaagaggtttctcatgctttgaaacaatcaattcgaagaggcttgccaagggttgaggcaagacactatctttcagtataccaagacattgagtcccataataaggttttgttggagtttgctaagatcgatttcaacatggtacaacttttgcatagaaaagagctaagtgagatttctaggtggtggaaggatttagactttcaaagaaagttgccatacgcaagagatagagtggttgaaggctatttttggatctcaggagtgtactttgagccccaatattctcttggtagaaagatgttgacaaaagtgatagcaatggcatctattgtagatgatacatatgactcatatgcaacatatgaagagctcattccctatacaaatgcaattgagaggtgggatatcaaatgcatagatgaacttcctgaatacatgaaaccgagctacaaggcactattagatgtttatgaagaaatggaacaactggtggctgagcatgggagacaatatcgtgtcgaatatgcgaaaaatgcgatgatacgacttgctcaatcttatcttgtggaggccagatggactcttcaaaactacaagccatcattcgaggagtttaaggctaatgcattgccaacttgtggttatgccatgcttgctattacatctttcgttggcatgggagatattgtaacaccagaaacctttaaatgggcagccaatgaccctaagataattcaagcttccacaattatttgtaggtttatggatgatgttactgaacacaagttcaaacataggagagaagacgattgctcagcaattgagtgttacatggaagaatatggtgtaacagcacaagaggcatatgatgtattcaacaagcatgttgagagtgcttggaaggatgtgaatcaagggtttctgaaaccaacagaaatgccaacagaagttttgaatcgtagcttaaaccttgcaagggtgatggatgtactctacagagaaggtgatggctacacatatgttggaaaagcggctaagggtggaatcacttcattactcattgaaccaattgcactttgaaatcgtattaaattttcctcttcagttccttaaggaatagttattaagttataattaataatgttttataatattcatatatatattataaaagaaagtttaaatcaactgtctttgtattcatttccttgtattgatccaataaagttcttttcaa

SEQ ID NO: 590 - DNA, 5450 bp, Gossypium hirsutum
  (+)-delta-cadinene synthase
gttggtcaaagggctttgttggtcaaaattgtcaattcaaggattcaattgagtagaagaggttccgagggatttaattattttttttaaagttaaaattcttaataagcccatattattttgattaattctatcagtcatctctaatttattgccaatagtcttatagcataatgtcaaatttagccaccatatttatatattttgtcaatttaactctttttcttattctttttagctaaatttgcccttagtcttttaaaaaagagtcaaaaaatttgtttaaacaaaaatcctaactaaaacattaatttttcaacaaagttgacatggaaacttgtgttacagaccacatgtacttcatgtagacataactctatttattatatgccacaccaacaagtaatttaaaaattacaaaaaaaatcaaaaaaataaataataataataatatggagtacatgtggattagtatgtgagctgccatgtttaaaaatttaacggtttattttcattaaaaaaatagcatttcaactatttttgaaaggtttaaggttaaatatgattttttttaaaagggtgaggaccaattttagctaaaaaaataaaagtcaaattaacaaaaaagaatgtaaatgttgagaactaaatttaacgttatgcctattcttaattagttctaaacttcaaaataggttaattaaatctttaaaatattagcattgtatctatgcaataaattttaacgtattaaaaaattaatgtcaataaaatattatctatgttacagatagatacatctttacaatttgatctacgtatttcatatacactttaactcaagcttgagttgacatttaatgcctaaactaattgttaagctaatggaaaggcttgattgatatgatactaatactttgcggattgaattaaaatatttttaaaatttaaaattgaatttaaaatctgcataatttgagaacattacgtcatagtttaatgtgtttatggtaaattagtcaatagtataatagtaaacaagttacgttgcctagtccttgatcaaacctgacatgctctattataatagtaaacattaacttctctttactcagtttaattgtgggattgtaattatcatttatgttggccttaaatcgtaggattagaactatttaatttgacttgattaattttcaaaattacatgctatttcggtttaaaaattattataaatattataaatattataaatattacgtcatagtttatgtgttcatggccaattagtcaataggataatagtaaacaagtgacgttgcttagtccttgatgaaacctgacgtgctctattataaaaatcaatcaaaaagattagtgggaagaactgagaaacaaaagtctttgggtctgaaacaaatgcatgcaccgatctaactttcagatgccttaaagattaacaatggttaggacttaaaagatcgttaaagattatttattatttgaaaacaggtttcttgcatttaatatattattaataaaattttatcgattttaaatatatataatttttattaattttaaaaaatagttatatttatataaaaaaaaatagtattgggttaattgattaaattaaaaattggtggtctgtctaattttgtacatacccaagatagaaaatacatatctttattagctaattactacttcttttttaaggaactagttactactttttagacttatttaatatgaaatcacatttaacatttaattatgttttaattaaataatttagttcagttggtccaactgatttaatttatattttaattgaggctgaccggccgagggaaggactgaaatgatatatttctataattctaaagttcaacagaggataaatatttactttgtaacacatttctacacatttcatcttctaatattttacaggcatcaactttgaataagagaatcaaacaaaaagacaaatcaacatctcttttaatctatttgcaattctcatgcaatgagccgccctacaccaatcttattgtataattgtttccttgcatataggttgtcttttttgacttaaactcaccagtatattttacctataaatacatgcaacaattgcactcttatcctcacagattctgtgccaaatttcaagagcaaaccaaaaaaggcagcaaattaagcttttcaatatttgcttttaatcaatcgaaatggcttcacaagtttctcaaatgccttcttcatcacccctttcttccaataaggatgaaatgcgtcccaaagccgattttcagcctagcatttggggagatttcttcctcaattgtcccgacaaggtatacatacatatgaccatattggtatatatataatcttaacagattatttgtttagttatttagtgattcaatatgaagcaaattttcattattttgagcagaatattgatgctgaaactcaaaaacgccaccaacaattgaaagaagaagtgaggaagatgattgtggcaccaatggctaattcaacccaaaagttagccttcattgattcagtccaaagactgggtgtgagttaccatttcaccaaggagatcgaagatgaactagagaatatctaccataacaacaatgatgccgagaacgacctctacaccacatcccttcgattccgactactccgagagcatggattcaatgtttcatgcggtaattactggaacaacaacatggtatttttaagtttcttgagtatataatagcatggaatgtttgataacaatatttcattttgggtaatttcatctcagacgtattcaacaagtttaaagacgagcaagggaatttcaagtcatccgtgacaagcgatgttcgaggattgttggaactttaccaagcttcctatttgagggttcatggggaagatatattggatgaagcaatttctttcaccagcaaccatttaagccttgcagtagcatctttggaccatcctttatccgaagaggtttctcatgctttgaaacaatcaattcgaagaggcttgccaagggttgaggcaagacactatctttcagtataccaagatattgagtcccataataaggttttgttggagtttgctaagatcgatttcaacatggtacaacttttgcatagaaaagagctaagtgagatttctaggtatgtttttgaatctctttcacgcatttttttttcttttttgtctttttttttttggtggaaggagggttgaatttaatcgcggcatcattctcaatataggagacgagttgcaaatgctaatatttgaatcttaatatatagcacaagttaaaagtgatggattcatctttttcacttacattattttacttatattatataagttatatatatattttaaaatttcaggttgccaatttacttaagaatctaacaatttacttattgacaacatgaatgtgaaacaaattaaaactttgaatattcattttgctaatggggttttctatgatatgatttttttaggtggtggaaggatttagactttcaaagaaagttgccatacgcaagagatagagtggttgaaggctatttttggatctcaggagtgtactttgagccccaatattctcttggtagaaagatgttgacaaaagtgatagcaatggcatctattgtagatgatacatatgactcatatgcaacatatgaagagctcattccctatacaaatgcaattgagaggttagatttctaaaattttgttggtaataggttaggtttctttagttgaagttaacattgaagttgaattcaggtgggatatcaaatgcatagatgaacttcctgaatacatgaagccgagctacaaggcactattagatgtttatgaagaaatggaacaactggtggctgagcatgggagacaatatcgtgtcgaatatgcgaaaaatgcggtatgtacatcaacaaacatttattttgtacaaaagagataagatcttagctaaattctagatttgaataaacaactaacttgaataacaatatataatcatttaaatattattattgaatttgaattgatattagtgataattgttgggattttgtcgcctcagatgatacgacttgctcaatcttatcttgtggaggccagatggactcttcaaaactacaagccatcattcgaggagtttaaggctaatgcattgccaacttgtggttatgccatgcttgctattacatctttcgttggcatgggagatattgtaacaccagaaacctttaaatgggcagccaatgaccctaagataattcaagcttccacaattatttgtaggtttatggatgatgttgctgaacacaaggtataataatatatttaaataatcacaagaaaccaaactattaactcaataacgatggtttttgtcatgatttgaaacaattaaagtttaatgtttatatatcaaatgtttagccttaaatcgaagaataagaaaagatatctagtttcattttaaaaatatatatagtttaacaaacgaatagaatttaggttatatagtaattgaataatttttattttattatggttgcagttcaaacataggagagaagacgattgctcagcaattgagtgttacatggaagaatatggtgtaacagcacaagaggcatatgatgtattcaacaagcatgttgagagtgcttggaaggatgtgaatcaagagtttctgaaaccaacagaaatgccaacagaagttttgaatcgtagcttaaaccttgcaagggtgatggatgtactctacagagaaggtgatggctacacatatgttggaaaagcggctaagggtggaatcacttcattactcattgaaccaattgcactttgaaatcgtattaaattttcctcttctgttccttaaggaatagttattaagttataattaataatgttttataatatatatattataaaagaaattctaaatcaactgtctttgtattcatttccttgtattgatctaataaagttcttttcaagctttcatttgtgaaaaatctgctcttttatattttatattttaattttccttctttcgttgctatagctttgaacacaaaatttagagtatgatcctatcatgctcttcctttttaccaacattgttgtcactttcaatgatttttctcttcttcgccataacattatcatcaagattgcatgtgataaagttttgccattcagatagccttttcaaggctcgccactagaagctcacttaaatagggatacttgttaataaaatatttttgttgtccttgtttctaggcatatagttgttgcacatcaaggatttagtggctacaaatcatgggtttatttggtttagatttttttccttagttgtt

SEQ ID NO: 591 - DNA, 1820 bp, Gossypium hirsutum
  (+)-delta-cadinene synthase
caagtttctcaaatgccttcttcatcacccctttcttccaataaggatgaaatgcgtcccaaagccgattttcagcctagcatttggggagatttcttcctcaattgtcccgacaagaatattgatgctgaaactcaaaaacgccaccaacaattgaaagaagaagtgaggaagatgattgtggcaccaatggctaattcaacccaaaagttagccttcattgattcagtccaaagactgggtgtgagttaccatttcaccaaggagatcgaagatgaactagagaatatctaccataacaacaatgatgccgagaacgacctctacaccacatcccttcgattccgactactccgagagcatggattcaatgtttcatgcgacgtattcaacaagtttaaagacgagcaagggaatttcaagtcatccgtgacaagcgatgttcgaggattgttggaactttaccaagcttcctatttgagggttcatggggaagatatattggatgaagcaatttctttcaccagcaaccatttaagccttgcagtagcatctttggaccatcctttatccgaagaggtttctcatgctttgaaacaatcaattcgaagaggcttgccaagggttgaggcaagacactatctttcagtataccaagatattgagtcccataataaggttttgttggagtttgctaagatcgatttcaacatggtacaacttttgcatagaaaagagctaagtgagatttctaggtggtggaaggatttagactttcaaagaaagttgccatacgcaagagatagagtggttgaaggctatttttggatctcaggagtgtactttgagccccaatattctcttggtagaaagatgttgacaaaagtgatagcaatggcatctattgtagatgatacatatgactcatatgcaacatatgaagagctcattccctatacaaatgcaattgagaggtgggatatcaaatgcatagatgaacttcctgaatacatgaagccgagctacaaggcactattagatgtttatgaagaaatggaacaactggtggctgagcatgggagacaatatcgtgtcgaatatgcgaaaaatgcgatgatacgacttgctcaatcttatcttgtggaggccagatggactcttcaaaactacaagccatcattcgaggagtttaaggctaatgcattgccaacttgtggttatgccatgcttgctattacatctttcgttggcatgggagatattgtaacaccagaaacctttaaatgggcagccaatgaccctaagataattcaagcttccacaattatttgtaggtttatggatgatgttgctgaacacaagttcaaacataggagagaagacgattgctcagcaattgagtgttacatggaagaatatggtgtaacagcacaagaggcatatgatgtattcaacaagcatgttgagagtgcttggaaggatgtgaatcaagagtttctgaaaccaacagaaatgccaacagaagttttgaatcgtagcttaaaccttgcaagggtgatggatgtactctacagagaaggtgatggctacacatatgttggaaaagcggctaagggtggaatcacttcattactcattgaaccaattgcactttgaaatcgtattaaattttcctcttctgttccttaaggaatagttattaagttataattaataatgttttataatatatatattataaaagaaattctaaatcaactgtctttgtattcatttccttgtattgatctaataaagttcttttcaagctttcatttgtg

SEQ ID NO: 592 - DNA, 5351 bp, Gossypium hirsutum
  (+)-delta-cadinene synthase
catgtgtggccatattagtgtagattccacatggccagggacacggatgtgtgtccaagccgtgtaactcactgtttgtggtacaaagccacacagccagagacacgtgcatgtacccaggctgtgtgagtcacacagacaaggacgggtgtgtatctagttcatgtaactcattgtttatgctttggaaccacacgagtgagacacatggccgtgtgacctggtcgtgtggcatgttattagggctcgaaacctgttcttaaggccgaaaacattacttaacactaatactggcctcttcaatgtacgaataattgaatttgattatatgtgaactgtctgatactctaagattgatctgtgagctacatagttatatgtatactataatgcttattatgatgtcgaactcttttatttaattatgaaatagattagaatgactgaatgcatgatacggtatttgtgttatgcattggcatgggttggtattttgtgaagaaggaagaattctattctgaaaatgtggctacgccatactgatctagtagctaaactgcatctctgtaaaagtgtcaacgaacactctaaggtgtgcagggttggttgggcattgaatatccctaaatggtgtgttgggatggctgaaaacggtgtctagcgaatggggataggaatattgcatctaaatctgatctgtatcgtatatgatctgaaattgtatatatatatgtaactaatctactctgaatctgaactgaaattacttctgtatcgaaccgaatccctaaatttggaactactttataaatgagtattaattgaataaacttcttttacgtaaagtttacaactcattttgatattgcttggatttcaagtggttcgcagaactgaacgggtcgatgccgcgagagctcggtcaagcttttagctttttttaaattatttcgataagagttttgataaactataatagtatgactttggaagattatatgtctaactaagctttgtgttaaattttatgtgaatcatggtttggtattattgtgttttgtgtagtatttaagtattgataatgtaactctctaaacttggactggatgcctaggctgggtctagggtgttacagttctattttcccccatctatactcggtgcacaaatgagtttcaaacaaatgaaccttgaggatacaatgaaacccggtgactatttgcattttacattgatgaaaatagcccactaagcactgaatagagtaaaataagaaaatcaatttctataataattttctacgactattctttataaaacaatctaagaaaaatagaagatggaggaagaatataaagatctttgagaactttttgctatatttttcaaatggaatctcactcttatttttaggaattctcatatctctttccaataagtgtcttttctaaataatcacatctttagaagagatataattattcaactaatatctcttaaatagatataactattaaagtaagagatacaattattcaattaacctctcttaaataaacataactatttaagaaatactgtttgaatagttataattctttattaaaaaaatcaagtgatataactcttcataattagaagatttaacttattattatgaatagtcataactcttgatcaataactaaaaaaatataaattttgattaattacactattttatttatagttattaaaacactataaatatttaaaaatatttcaacattacaaacatcaaattcaaagttaaaagaaacaaacaaacaaaaaataaataaatagtaaaataccccaaagaaaaacatagcatctcaatcaatttgccattttccttcaatggacactacatgtattttattccactaattttatcttgaatttaaattgtccttttttttatttaaaatcaccaatatttatgtataaatacgttgaacaattgcactcttagactcgcacaaaatttgtgttatctttcaagagtgaatcaaactgacaacaaattaagcatttgaatcttgctttttcatcaaccgaaatggccaaacaagtttctcaacttctttcttcatcaccccttacttccaacaaagatgaaatgcgtctgaaagccgactttcagcctagcatttggggagatctcttccttacttgtctcgacaatgtatacacacacatatatatataagcatattgacatataattttaacatattatttgtttaattatttagtgttttaatatcaataaaatttgtattattatgaacaggatatcgatgctgaaactgaacaacgccaccaacagttggaaggaggagtgaggaagatgattgtggcaccaatggctaattcaacccaaaagttaaccttcattgattcggtccaaagactgggtgtgagttaccgattcaccaaagagatcgaagatgaacttgagaacatctaccataacaacaatgatgccgaaaatgacctctacactacatctcttcgatttcgattactccgagagcatggattcaatgtttcatgtggtaattattggaagaagaacatagtgtttttaagtttcttgagtatataataacatggaatgtttgataacgatatttccttttgggtaatttgatctcagaggtattcaacaagtttaaagacgagcaaggggattttaagtcatcattgacaagcgatgttcgaggattgttggagctttacgaagcttcgtatttgagggttcatggggaagatatattggatgaagcgatttctttcactactgaccatttaacccttgcagtagcaactttagaatatcctttgtctgaacatgtttctcatgctttgaaaaaatcaatccgaagaggcttgccaaggattgaggcaaggcactatctttcagtataccaagatattgaatcccacaatacggctttgttggagtttgctaagatcgatttcaacatgttacaacttttgcataggaaagagctaagtgagatttgtaggtatgttttttagtctttttcacccttttattctctttttcacaattttttttttgaggcatagggttgaatttataggaggggtcatctttagtattggagacgagttgaaaatgctaatattcaaatcttaaacattattaaatatcactagttaaaagtgattatatgaacattgaattcattttttttcaactatttcattttacttatatattttaaaatttgaagttgccaatcgaactaagaatctaacaatttacttgtcaacaacatgaatgtgaaactaattaaaactttgaagattcattatagtaatgaggttttttatgatatgattttttaggtggtggaaggatttagacttcaaaagaaagttgccatatgtaagagacagagtggttgaatgttttttttggatcctgggagtgtactttgagccccaatattcacttggtagaaagatattgacaaaagtgatagctatgacttctgttatagatgatacatatgactcatatgcaacatatgatgagcttattccatatacaaatgcaattgagaggttagatttttataattggaggttaaaattcaattatattacaaggaatgatcaaatataaccttaatttggattcaggtgggatatcaaatgcatagaccaacttccagaatacatgaaactgagctacaaggcattattagatgtttatgaagaaatggaacaactgatggctgaggatggaagacaatatcgtgtagaatatgccaaaaatatagtatgtacaccgacaaacatttattttgtacaaaagagataagatattagctaaattctagatttgaataaacaattaacttgaataacagcatataatcatttaaatattattcttgaaataaaaatatataatcatttaaatattattattgaaattgatttgatattagtgataattgttgggattttgttgacttagatgatacaacttgctcaagctttccttatggaggccaaatggactcttcaaaaccacaaaccatcattcgaggagtttaaggctactgcattgcaaactactggttatgccatgcttgctattacagctttagttgacatgggagatattgtaacaccagagacctttacatgggctgctaataaccctaagatcattcaagcttctacaattatttgtaggtttatggacgatgttgctgagcacaaggtataataatatatttttataataaaagaatgaaattcttaacttaataattgaatgtctttgtaacaaaaccaaacgatggtttttatcatgatctaaaacaaataaaatttgatttgtatgtatcaaatgtttagtcttaaacagaagaataagaaaaaaattggtttcattttagggttattgtcaataaagttattttatcatcactaaacaaatatagtttaatatactgacaagtgaagaataattttgatttttttacggttgcagttcaagcagaggagagaagatgatttctcgggaattgagtgttacatggaagaatatggcgtaatggtacaagaagcatacaatgtgttttacaagcatatcgagagtgcctggaaggatgtgaataaagggtttttgaaaccaaccgaaatgccaatagaagttttgaatcgtatactaaatcttgcaagggtgatgaatgtgctttacaacgaaggtgatggctatacatatgttgggaaagcaactaagggtattatcagcatattgctcattgaaccggtcactctttgaaaattacaataattttcctcttcaagcttgttcttaaggggaaattattaggttctgattataatactctcatgtattccaaaataaattccaaattgtctgtctttgtactctttacctttatgttaatccaataaagatatttgccaccttttctttgtgaaagttctcttttttttttcctttaattttaattttttatgtatttagttattgttttttttgtataaaataatatgtagtatgagaatagtaagagttatggactattaaatatcatcttttaaaaatagttgtataaataaattgaattaaatttacaatttttatttttatttttataaatgattaagatcaaaataacaaaaaaaatctattgaaaatcactgcttaaaattcactacaagattgaaatataaaatgcacttagttaattactacttaaaacccatcaaatgtatagctatttccaaaagattagtaatcaaattcaagagaa

SEQ ID NO: 593 - DNA, 2986 bp, Helianthus annuus
  germacrene A synthase 1
atggcagcagttggagccagtgctacccccttaacaaacaccaaaagcactgcagagccagtgcgtcctgtggccaacttcccaccttctgtatggggtgatttgttcctatcattctctcttgacaaatcggtaaggtttcccgctagctaattacaaatttaagggcggaaccaactcaccaaggggtcaagagggtttgctaatccccggttactagaatttgttggttttttatattaaaaaatatgagtgatagcccctacaaaaaagtcaccatgtacaagatacaatcgcatgacgttatgtagtttttttttttttccttaagaaataaaaataaggtgttttcttttctagataatggaagaatacgctgaagccatggaagagccaaaagaacaagtgagaagattgatcttggatcctacaatggattcaaacaagaaactgagcttgatttataccgttcaccgtctcggtctgacatacatgttcttgaaagagattgaagcccagcttgacagacttttcaaagagttcaacttggaagattatgttgaacttgacttatacacaatttcgattaactttcaagcttttcgacaccttggttacaagctgccttgtggtacgtaccggattctaacattaaatacttgccacttttgcatcatcagtacttgtttttttcacagagtccattatggttgccatcaaatgatttacaatataagttactcatgtcttctctttttcatgacataagtgatacaatattttatattaatttgtgaccgaacagatgtgtttaacaaattcaagaacgacgactcgactacattcaaggaatctattactggtgatgtgaggggtatgttaggcttatatgaatctgcacaattgagattgaaaggggaaaacattctagacgaagcctcggcgttcgcggaaactaaactgaagagtttggtaaatactctggaaggcagtcttgcacaacaggtgaaacaatctttgagaagaccatttcatcaagggatgccaatggtagaggcaaggctatatttctccaactatcaagaagaatgctccgcacatgactccatactgaaacttgcaaaacttcacttcaactatttgcagctacaacaaaaggaagaacttaggattgtttcacagtgagtcacataacatcctatatattggaattaataatgatgcattatttattaaaagtagataaaaacataataaatactcatatgaaaagggaaatatctatgaagcaacgtgtcttaaacccaaccgaaaacaagagtacaaaatacacactcacaatatatgcaatacaaactaagaatttattgaagatgtgagaaattataaaagtgaaaagttgatggaagtttattctaccttgtttcacaggtggtggaaggatatgaggtttcaagagacaactccttatataagggatagagtgccagagatttatttatggatattaggactctactttgaacctagatactctttggcacgaatcattgccaccaagattacgttgtttcttgtggtgctagatgacacatatgacgcttatgctaccattgaagagatccgccttctaaccgatgcaataaataggtacaagttataccaagtgttgctttaaaccatcatgcacttcgaaataaaattactaatgcttgaagatctctcgttatatatcaacatttgatattttaggtgggacattagtgctatgaatcaaattccagagtacattagaccattctacaagattctcctggatgagtatgctgaacttgagaagcaactagcaaaagaagggcgcgcaaatagtgttattgcttcaaaagaagcggtatgatcgatatgttataaattctggatttttcatgtactgattaacctctttaatatagaggtgtaaccaaattacacgataatgatataatgatagaacgccaataactatcataacattcaaactagagataaaataatattgactaacaaacaaagttaaagtatataaacagtagatcaaattataataactataacagataataaactagcctaacaatttgtatgttatgttaaatgaaaatttcatctccatagatattttgttaatctttggcttattgtatatctatatggagttcagttccaagacatagctagagggtaccttgaagaggctgagtggacaaacagtggatatgtggcatcatttccagagtacatgaagaacggattaatcacttctgcctacaatgttatttccaaatctgctttagtgggaatgggtgagatagtgagtgaagatgctttggtttggtatgagagtcatccacagattctgcaagcttcagagttaatttcaagactccaagatgatgttatgacataccaggtaaacaattaaactggtttaaaatgcaaagttaacttataaacatcatgtattctcactaacactatgactatttgtttaagtttgagcgcgaaagaggacaatccgccacaggtgttgattcatacatcaagacctatggcgtatcagaaaaggtagcaattgacgagctcaagaaaatgattgaaaatgcatggaaagaaataaacgaggggtgtctcaagccaagagaagtctcaatggatttgctggccccaattcttaaccttgctcgaatgatagatgtggtatacaggtatgacgatgggtttactttcccaggaaagacactcaaagagtacattactctcttgtttgttggttcttcacccatgtaataatggaaatattgttgcttgttgtggtgtatctctaggacaatatctcaatcgtgatttttgtaccgtataaggatattaatatattttgtaacataatcgacattgtcgatgtatgaatatttttatgacttggtgtaagtggatatgttatatacac

SEQ ID NO: 594 - DNA, 1680 bp, Helianthus annuus
  germacrene A synthase 2
atggcagcagttggagccagtgctaccctcctaacaaacaccaaaagcgctgaagagccggtgcgtcctgtggccaactttcctccttctgtatggggtgatttgttcctatcgttctctcttgacaattcgatgatggaagaatatgctgaagccatggaagaaccaaaaggacaagtgagaaaattgatcttggatcctacaatggattcaaacaagaaattgagcttgatttataccgttcaccgtcttggtctaacatacatgttctttaaagagattgaaggccagcttgatagacttttcaaagagttcaacttggaagattatgttgaagttgatttatacacaatttcgaccaactttcaagctttccgacaccttggttacaaactatcttgtgatgtgtttaacaaattcaagaactacgactcgaatacattcaaggaatctattaccagtgatgtgaggggtatgttaggcttatatgaatctgcacaattgagattgaaaggagaaaagattctagacgaagcatcggcattcacagaaactaaactgaagagtttagtaaagactctggaaggcagtcttgcacaacaggtgaaacaatccttgaaaagaccatttcatcaagggatgccaatggtagaggcaaggctatatttctccaactatcaagaagaatgctccagacatgactcactactaaaacttgcaaaacttcacttcaactatttgcagctacaacaaaaggaagaacttaggattgtttcacagtggtggaaggatatgaggtttcaagagactactccttatataagggatagagtaccagagatttatttatggatattaggactctactttgaacctagatactctttggcacgaatcattgccactaagattacgttgtttctcgtggtgctagatgacacatatgacgcttatgctaccattgaagaggtccgccttctaacagatgcaataaataggtgggatattggtgctatgagccaaattccagagtacattagaccattctacaagattctcttggatgagtatgctgaacttgagaagcaactagctaaagaagggcgtgcaaatagtgttattgcttcaaaagaagcgttccaagacatagctagagggtaccttgaagaggctgagtggacaaacagtggatatgtggcatcatttccagagtacatgaagaacggattaatcacttctgcctacaatgttatttccaaatctgctttagtgggaatgggtgagatagtgagtgaagatgctttggcttggtatgagagtcatccacagattctgcaagcttcagagttgatttccagacttcaagatgatgttatgacataccagttcgagcgcgaaagaggacaatccgccacaggtgttgatgcatacatcaagacctatggcgtatcagaaaaagaagcaatcgacgagctcaagaaaatgattgaaaatgcatggaaagaaatcaacgaggggtgtctcaagccaagagaagtctcaatggatttgcttgccccaattcttaatcttgctcgaatgatagatgtggtatacaggtatgatgatgggtttactttcccaggaaagaccctcaaagagtacattaccctcctgtttgttggttcttcacccatgtaa

SEQ ID NO: 595 - DNA, 1674 bp, Helianthus annuus
  germacrene A synthase 3
atggcagcagttgacactaatgccaccatccaagaaaagaccaccgcagggccggtgcgtcctttagccaacttccctccttcggtatggggtgatcgcttcctatcattcactcttgacaattcggaactcgaaggatatgcaaaagccatggaagccccaaaagaagaattgagaagattgattgtagatcaaacaatggattcaaataagaaactaagtttgatttattccgtccaccgtcttggtttgacatatctgttcttgcaagagattgaagcccagctagacaaaattttcaaagagttcaacttgcaagattatgatgaagttgatctttacacaacttctatcaactttcaagttttccgacaccttggttataaactaccttgtgatgtgtttaacaaattcaaagacaatacctccggcgctttcaaggaagatatttctacggatgtgaagggcatgctaggcttatacgaatcttcacaactaagaacaagaggagaatcgatactagatgaggcttcatcgttcactgaaactaaactcaagagtgtagtaaacaatcttgaaggaaaccttgcacaacaggtgttacaatcattgaggagaccatttcatcaagggatgccaatggtggaggcaaggctatatttctccaactatagtgaagagtgtgccacacatgagtgtttattaaagcttgcaaagctgcatttcagctatttggagctacagcaaaaggaagaacttcgcattgtctcaaagtggtggaaagatatgagattccaggaaactacaccttatataagggatagagtaccagagatttacttatggattttgggattgtactttgagccccgttactccttggcacgaatcatcgccacaaaaattacattgtttcttgtggtgctagatgatacatatgacgcttacgctaccattgaagaaattcgacttttaactgatgccataaataggtgggacatgagtgctatggagcaaattccggaatacattagaccattctacaaaattctcctagatgagtatgctgagcttgagaaacaactagctatagaaggaagagcaaagagcgttattgcttcaaaagaagcgttccaagacattgctagaggctaccttgaagaagccgagtggacaaacagtggatatgtggcatcatttcctgagtacatgaagaatgggttaatcacttcagcctacaatgttatttcgaaatctgctttagtgggtatgggcgacatagttagtgaaaatgcattggcatggtacgaaagtcatccaaagactctacaagcttccgagttaatctcaagactccaagatgatgtcatgacttaccagtctgagcgtgaaagaggacaatcagccactggagttgatgcgtatatcaagacatacggcgtgtcagagaaggaagctattgatgagctaaagataatgattgaaaatgcatggaaagatataaacgagggatgtctcaagccaagagaagtctcgatggatttgctcgcgccaattcttaaccttgcaagaatgatagatgttgtgtatcgatatgatgatgggttcacctttcctggaaaaaccatgaaagagtatattactcttttatttgttggttctgtatccatgtaa

SEQ ID NO: 596 - DNA, 1944 bp, Helianthus annuus
  gamma-cadinene synthase
gataagccgcgttcgttgcaccaactcccattccacaaatggcaacaactgaagctaacactatggcgcaagctaactcacaaaccaccatagagccggtgcgtcatctggcaaactttccgccttcgatttggggtgatcagtttctatcattctctcttgataattcccaattggaagcatacagtaaagctatggagcagccaaaagaaaacgttagaagaatgatattaaaccctgctattgatacaaatgagaaattgggtttgatttattgtgtctatcgtcttggtttgacgtataatttctcaaaagatattgatggtcaacttgatgaacttttcaaacagcttaacttgcaaagttacaacgaagcagatctctatacaatatccattcactttcaagtttttagacactttggttatagattttcttgtgatgtgtttaacaagttcaaggactccagttctggtaaattcaaggaagacatgactagagatgtgaggggtatgataagtttgtatgagagtgcccaactaagaataagaggagaatctatactagatgaagccggtgcattcgcagaaagtaaacttaaaacgatagaaaaaacacttgatggtacacttgcacaacaagtcaaacatgtattggagagaccttttaatcgagggcatcagatggttgaagcgaggaagtatttgttcctatttgaagaagaaatttcacggtatgattccctattgatgcttgcaaaggtgcattttaactacttgcaactcctacaaaaggaagaacttcgatctgtatcaaagtggtggaaagacttggacctaccggcgaaaacactatatgtaagagatagagtacctgaactctatgtatggattttggcgtttttcttggagccgtattactctgaagtccgaataataacgaccaaaatcgtactgcttgtattggtgttagatgacacgtatgatgcatatgctactattgaggagagccgacttctaacccatgcaataaataggtgggaagttagtgctatgttgcaacttccagaatacatgaaaccattgtatgaaattttgctcaacgagtatgatggattttacaaacatggaagaacaaatgtcattgagacttcaaaaaaagctttccaagacttggctagaagttaccatcaagagtctgaatggagacatgctaaagaggtgccatcatttgaagagtatatgaaaattgggacaactacttctgcacataatgttcttagtaagactgcattgattggtatgggcaacattgtaacacgcgaggctttagcttggtacgaaagctatccaaagatcgtacaactttcagagttgatcggaaggctcgaagatgatgtcgtcagtgttgagtttgagcgtgaaagagctccaacagccacaagtgtagatgcttatatgaagacttatggggtgtcggaaaatgtagctgtcaagatactcaaaaaacttgttgaaaatggatggaaagatctaaatgaggcgtgtctaaagccaacagaggtctcattggatctgcttgctccgattattggtcttacaaacatgacagacgtggcgtacaggcacaatgatggtttaacttttccagaaaagactcttaaggaatatattacactcctgttttgtgttccagtccccatgtaacaactagtgtgttagttcgtgttgttgttcttctctttcgcttttgttttgtttctccagtttcttactggctctctatatataaacatatagtgtggttgccgtttaaaaaaaacaactagtgtgttagtggttacttaccgacgcatatgtatcttggtttaacgtaaggatgaataactgatatctaactagtgggtatccttattagtgtttaaaaaaaaaaaaaaaaaaaaaa

SEQ ID NO: 597 - DNA, 1750 bp, Hyoscyamus muticus
  premnaspirodiene synthase
gttgacaatcaggttgcggaaaagtatgctcaagagattgaaactttgaaggaacaaacaagtactatgttgtctgctgcttgtggaacaacattgactgagaaattgaatttgatagatattattgagcgccttggaatagcttatcatttcgagaaacaaatagaagatatgttggatcacatttacagagctgatccttattttgaggctcatgaatacaatgatttaaacacttcatccgttcaatttcgactactcagacaacatggttacaacgtctctccaaatatatttagcagattccaagatgcaaatggcaaattcaaggagtctcttagaagcgacatcaggggcctactgaacttatacgaagcttcacatgtaaggactcataaagaggatattttggaagaagcacttgttttttctgttggtcatcttgaatctgcagctccacatttgaagtcacctctgagtaagcaagtgacacatgccctcgaacaatctctccataagagcattccaagagtcgagatacggtacttcatctccatctacgaagaggaggaatttaagaatgatttgttgcttcgatttgctaaattggattacaacttacttcagatgttgcacaagcatgaactcagtgaagtatcaaggtggtggaaagatttggatttcgtgacaacacttccatatgctagggacagagcagttgagtgctacttttggacgatgggggtgtatgctgaacctcaatactcccaggctcgtgtcatgcttgctaagactatagcaatgatttccatagtagatgacacattcgatgcttatggcatcgtaaaagaacttgaagtctacacagatgccatacagaggtgggatattagtcaaattgatcgactcccggaatatatgaaaatcagttataaggctcttttggatctctatgacgattatgaaaaggagttgtcaaaggatggtagatccgatgttgtccactatgcaaaagaaagaatgaaggagattgtgggaaactattttattgaaggaaaatggtttattgagggatatatgccatctgtttccgagtaccttagcaatgcactagctactagcacatattacttgctaactacgacatcctacttgggaatgaaatcagcaaccaaggaacattttgaatggttggctacgaaccctaaaattctggaagctaatgctacattatgccgagttgttgatgacatagccacgtatgaggttgagaagggtaggggtcaaattgcaacaggaattgagtgttatatgagggattacggtgtatccacagaagtagcaatggagaaattccaagaaatggctgacatagcatggaaggatgtaaatgaagaaattcttcgaccaacacctgtctcttcagaaattcttactcgtattctcaacctggctcgaattatagatgtcacttacaagcataatcaagatggatacactcatcctgaaaaagtactaaaacctcacatcatcgccttggtggtggattctattgatatttgaatcaccaattgttgtgtacacctgggagcacttggttcccaccccctcaaataagtttttgacagacacttgatggatggtatctctgttgctaggtatacatgttgtaatcgtgcagtgaagttacgtccttaattcttttgtatgattatttacatttgaaatataataattctgctttttaact

SEQ ID NO: 598 - DNA, 1273 bp, Hyoscyamus muticus
  vetispiradiene synthase
ctccataagagcataccaagagtcgagacacgctacttcatcaccatctatgaggaggaggagttgaagaatgatgtgttgcttcgatttgccaaattggatttcaatttacttcagatgttgcacaaacaagaactcacggaagtatcaatgtggtggaaggatttggatttcgtgacaacacttccatatgccagggacagagcagttgagtgctacttttggaccgtgggagtgtatgctgaacctcaatattctgaagctcgtgtcatgcttgctaagactatagcaatgatttcaatagtagatgacacatttgatgcttatggcattgtaaaagaacttgaggtctacaccgatgccatacagaggtgggatattaaccaaattgaccggctcccagattacatgaaaatcagttacaaagtacttttagatctctacaaggattatgaaacagagttgtcaaaggatggcagatccgaagttgttcactatgcaaaagaaagaatgaaagaaattgtgagaaactattttgtggaagcaaaatggttcattgaaggatatatgccacctgtttccgagtatcttaacaatcgattagcgactagcacttattacttgcttacgacaacatcctacttgggcatgaagtgtgctaacaaggaagattttgagtggttgactaagaaccctaaaattcttgaagccaatgtgaccttatgtcgagtcattgatgacatagcgacctatgaggttgagaagggtagaggtcagattgcaactggaattgagtgctacatgagagattatggtgtatcaacagaagaggcaatggaaaaatttcaagaaatggcagagatagcatggaaggatgtaaatgaaggaatccttcgaccaactcctgtctccgcaaagattcttactcgtattcttaatcttgctcgcattattgatgtcacttatttgcacaatcaagatggatacactcatcctgagaaagtactaaaacctcacattatcgccttggtggtggactctattgaaatttaaatcttcaattgttgagtacatcttggagcacctggttctcgctccctcaaagaagtattttcatcgacatctgatggatgccttgttggtattttgttgttagctagagtaggtaggagttgctgactatatatgttcttatcgtgcagtgaaattgccttcttaaattattttgtatcattacggaaatttgaattatattaatgcttcttttacaaga

SEQ ID NO: 599 - DNA, 1956 bp, Ixeris dentate
  germacrene A synthase
gaaagcaacgaactccagcaatcactccttcaaaaatctcatcataaaatggctctcgtgagaaacaacagcatcaacggtcgtgaaccagttctcagtcccaggagcctcactagcccccgtggcttaaccagcccccggccactggctgtccaaccgactcctgagccagttagacctttggccaacttcccgccttcaatatgggctaatcgtttcatctcattctctcttgataactctgaattggaagcttacgcaaatgcacacgaggagcctaaagaatctgtcaggagtttgataaccgataccaccattgatgcatctgcaaaactaaagttgatctactcagtgcaccgccttggtttatcgtatctttatcccgaagagatcgatgctgagcttgaccaactcttcaagaaaatcgacttgcatcattacgaacaagttgatttgtacaccatttcagtacaatttcaagttttcagacatcatggttataaattatcatctgacatatttaaaaaattcaaggacaccacaacgggtacattcacagacgaagtcacaaaagacgtgaaaggtatgttgagtttatacgaatcagctcacttgaggctacacggtgaagaaatcttagatgaagctttggtattcaccgaggcccaacttaaaaaaatcgtgagcacacttgagggagatcttgcaaaccaagtgaaccaagtcttgaaaagacctttccacaccgggatgccaatggtggaggcgagactatattttaacacgcacgaagaagatgtttcgtgttatgaatcgattgtaaagttagctaaagtccacttcaactatttgcaacttcaacagaaggaagaacttcgtatcgtgtcacagtggtggaaagatatggagtttcagacatcggttccttacataagagatagagtaccggagatatacctatggattttggggttatactttgagccatattactctcgggcacgtatcatagcaacaaaaatcacgttgttcttggtggttttagatgacacgtatgacgcgtatgctacaattgatgagatccgagcgatcacggatgcgattaataggtgggaaatgagtgcaattgatttgcttcccgagtacatcaaaccattctaccgaattctcctaaacgagtacgatgatctggagaaagaatactctaaggatggaagagccttcagtgtccatgcttcaaaacaagcgtttcaagaaatagcgagagggtatcttgaagaggcggagtggttacacaatggttatgtggcgacatttcccgagtacatgaagaacgggttgattacttcggcttataatgtcatttcaaaatccgcattggtgggaatgggcgcgattgcagatgaagaggctcttgcttggtatgaaacacatcccaaaattctaaaagcttcagagttgatttcaaggctacaagacgatgttatgacttttcagtttgagaggaaacgaggacaatcggctacgggtgtggatgcttacatcaaggaatacaatgtatcagaagaagtggcgatcaaagatctcatgaagatgattgaaaacgcatggaaagatataaacgaaggatgcctaaagcctacagaggtctctgtggctctactaactcccattttgaatcttgcaagaatgatagatgtggtatacaagttcgatgatgggttcacttttcccgggaaaaccttaaaagactatattacccttctgttcgttacccctgcacctagtcttgaaagctgctaggttgtaatacaagcattacattttcttggaactttgctttttatgttgacgcgtatgtttgcgctcgatatggtgaattttttaaacattctgttgtactattctcgttgccaaataaagcaaatttttttgttaaaaaaaaaaaaaaaaaaa

SEQ ID NO: 600 - DNA, 8487 bp, Kitasatospora griseola
  diterpene cyclase-2
ggatcccgaggagggagcgaacgtgcaggtgcgcagagtacgagcacatgcctgaaggcaggtcgtaccgggccgggcgctcacccgactacctgcggggtgatcggcaaagatgtcgaaaactcgttgcttgctttgaaagcgcaaagaccggtccgtaggctcggccccactcaagagcccgacatgaagccggctcaaggagattcccccaagtcctcgtgacaaccctggaggtaccccatgacagatcaactctccgctgccgacttgccacgcacgtcggaaccgactttccggcggatcccggtgctgctgatgctggttacctgccagctgatgctggtcatcgacgccaccgtgctgaatgtggcgttaccacatattcaaatcgatctcggcttcacctccaccggtctctcctgggtcgtgaacgcctacattctggttttcgggtgcctgctgctgctgggcgggcgggccggtgacctgttcggtcgacgccgggtgttcgtggcgggagtcgccgtgttcacgtgcgcctcgctggccgccggcctcgtcgactcggccgctgcgctggtgatcgccagggttgttcaggcgatcggcgccgccgccgccggaccgaacgcgcttgcgctcatcaccaccaccttcaccaaggaagaggatcggcactggtccctcgcctggttctccgcgatcgccagtgggggttttccgatcgggttgatcgtcggcggtctgttcaccgactggctgtcctggcgggcggccatgttcatcaatgtgccgatcgggctcgcgatcgccctgttgaccccgcgattggtgcccgccccgacccgtcatgcggcccgcctcgacctgccgggcgcgatcaccgcgaccggtggtgtcgcggcactgattttcgggcttctacgggccgccgagcggggttggagcgatgggccgaccatcgccgcgctgggcatcgggctggttctcgtcgcagcgttcctggccatcgagtcgcgcaccgggcagcctctgatgccgctgcgggtgttcgccgaccgtgaccgtgccgcagcctatgtgatcacgttcctgatggcgatggcgatgatctcgaccttcttcttcctcacccagttcctgcagaacgtgctcggatggaatgcgctcgtcaccggattcgcgttcctgcccatggcgctcggcctggtcgtcaccagtcgcctgaccgcccggctgctgccccggctcggaacgaaatggctcatggtcatcggtgcctcgctgatcgccgtcggcatggtctgcctcacccagctgtccaccgacagtgggtacctgtccggactgctcgtaccgatgctgctgctgggcatgggcatcgggttcacgttcgccacggccaacgtggcgatcatgtcgactgtggaggcgcaggacgccggcgcggcaggcggtgtcctgcagaccatgcaggaggtgggctcgtcggtcgggctcgccgtgctcatcaccgtcttcggtttcgcgaccggccacgcacgtgtcctcccgcacggactcctggtcgacggaatggccgtggcattcgccggcgcggccgtcttcgccgcctgcggcatcgcggcggcgttcggtatccggcacaggcagtcggcggacacctgaccggtcgggggcgatgcgcggagggccggcggggcgagcaccgtccgaccggctctacacgccggtggcgccgtcgatgcgttcccggaccaggtcggcgtgcccgttgtggcgggcgtactcctcgatcatgtggacgtagatccagcggaggctgacgtcctggtccatgaatcggccggtgttggacagcgcacggccgacggagtgctcgcgggcgcggacgacttccgcctgccacatggcgagagtgtcctgcagagtgacgccctcgcccagttcgaaaccgccgtccgggccgtccgggtcggcctgcgggtcgtagatgggtgggacttgttctccggcgagcacccggcggaaccagttccgctccacctccgccatgtgctggaccaggccgatcagtgtgaagccggacggcggcactgacgcgacggcggcctgctcgtcgtccaggccttcgcacttcatggcgagcgtggcgcggtggaagtcgagccaactctcgagcgtggtgcgctcgtcggcgttcaagggcggtaccgggcgttcggcggtgctcacccgaccaagtatcggtgaccgtcggccgaatccgtcggctgacagggcctgtcagcagggcgaacagttgtccagtgcagacgagtggcgatccgagagtgatgcgccggcaaagcccttgccagaacgtccagttgagcttgactgtgacacgtcatgaagcctagagtgctgcgtatcagtaccaccgggctgtcgttcatgaaagttgcactatcagcgactggagagatgcgctagatggctgacttagagaccaagtttcccaggtacgaactgatctcgtccggcaagtacgtggaccgcattccagagctccatgaattacgcgagaaatcccccattgcctgggttccggtcatggacgcagcttttctcactcgacacgccgatatcgtccgagtgctgaaagaccaccgcatggccccggccaacctgacacagggcatacggctgctcagccccgaacagcaagaggaattggagccgctgagcagcgccgtcaagaagtggatggggcacaccgttcccgcggatcatcagcggttcatcgggttgctgaagcgctacttcaccccggccatgatcgatcggatgcggccgcgcgtgcggcagctgtcgcacgaactgctggacgcggtggagccggccgggcgcatggacatcgtttccgacatcgcgtatccgctgcccgcgtgcgtcatcgccgagatgctcggcgtgcccatggacaacagggcacaactgctcgcctggtcggccgacatcggggcgatcgccgaaatcgtcagctatgaccggctcatggagtgccagcggagcctgctggcgatgcaggacttcgtcctggaggtggtcaaggagcgccgggcggagcccaaggacgacctgatcagcatgttcgtcgccgccgaacgcgagggcctcgtgagcgaggcggagatcctctccaactgcgtgatgctgctcttctccgggcacgagaccaccggcggactgatcaccagtggcctggtccagctcttcgatcaccctgatcagctggagctgctgaagtccgatcccgacctgatgccgggtgcggtcgaggagatgctccggctcgccggaccggcttcggtgatctcacgggtcagtaccgagcctgtcgaggtggctgggtcatcaattcgaagcggggcagcagttcctcctggcgctgatggcgggaaacgcgacccgcgggtattcgaggacccggaccgcttggatgccacccggcgtccgaacgaccacctcgctttcgccaccggcatgttctactgcctcggcgcggcgctcgcacggatggaggcggacgaattcttcaggattctgttggaccgcttccccgacgtcaatcccggatacgaaactcctgactggcagccggtgctgctcatcagccgacgcttgaagacgctccccgtcaatctgcggggtgtcggcggaagcggtgccggcgatgagtgacgccgatcggatagcggccctgttgaaggaccgcgctgccgacccggtgacgaagttcagcccctcgccgtacgagaccggacagttcctgcggatatccgagcgggcggacgtgggcacaccgcagatcgactacttgctcgcgacgcagcgaccggacggcctgtggggatcggtcgggttcgagctggtaccgacgctgggcgcggtggcgggtctgtcctcgcggcccgaatacgccgaccgggccggagtgacggacgccgtggcgcgggcctgcgaaaagctctgggagctggcgctcggtgagggcgggctgccgaagctgcccgacaccgtggcatccgagatcatcgtgcccagcctgatcgatctactgagcgaggtgctgcagcgccaccgcccggctgtcggtggcaaggccgggcaggagcaggagtttccgagtccgccgggcgcgaacgccgagctgtggcgccagttgagcgaccggatcgcccgggggcaggccatcccgaagaccgcatggcacacccttgaggcgttccatccgctgccgaagcagttcgcggcaacggtgacgcccgccgcggacggtgcggtgacgtgttctccgtcgtccacagcggcctggctgtcggctgtggggacggacgccggagcatcgacccgcgcctatctcgatgaagcgcagagccgctacggcggagcgatcccgatgggaagctccatgccgtacttcgaggtgctctgggtgctcaatctggtgctcaagtacttcccggacgtgccgatccccagggagatcatcgaagagattgccgccgggttcagcgattcgggcatcggcggcgggccgggtctgccgcccgacggagacgacacggcctacgccaatctcgccggcgacaaactcggcgcccccactcacccggaaatcctgatgaagttctgggccgaggaccacttcgtttcgtatccgggggagcaaacaccctcggagaccgtgaacgcgcacgccctcgagtacctcaatcatctcaggatgcgccgtggcatcacggaattcggcgccgtcgaggacgcatgtgccgagtgggtgatctcccagcagaccgaggacggctgctggtacgacaaatggaacgtctcgccgtactactccacggcggcatgtgtcgaagccctgctcgacgcccggaagcaggatgaaccgcagctggattcgctgcgtcgcgccagggaatggctgcttcgacaccagacggattcgggcggctggggaatggcggagccgtcacccgaggaaacggcctacgcggtgctggcgctcgacctgttcgcgagccgtggcggcgagggcgccgaggagtgtgcggcggcgatatccagggccaaggaattcttcacggacgagtccagggagaatcccccgctgtggatgggcaaggacctgtacacgcctttccggatcgtcgacgtgacggtgatgtgcggccgtgccgtcgtgggcaggtactgatgcccgacgcgatcgagttcgagcacgaaggccggcggaacccgaattcggcggaggccgaatcggcctacagctccatcattgctgcgctcgacctccaggaatccgactacgccgtgatttccgggcactcgaggatcgtgggggccgcggcgctggtctatcccgatgcggatgccgaaaccttgctcgcggcttcgctgtggacggcctgcctcatcgtcaacgacgaccggtgggactacgtccaggaggacggcgggcggctggctccgggcgagtggttcgacggggtcaccgaggtcgtggacacctggcgaactgccggaccccgcctgccggaccccttcttcgagctggtgcggacgacgatgtcccggctcgacgcagcgctcggcgcggaagcagcggacgagatcggccacgagatcaagcgcgccatcacggcgatgaagtgggaaggggtatggaacgaatacaccaagaagacgtccttggcgacgtatctgagcttccgccgcggctactgcacgatggacgtccaggtcgttctggacaagtggatcaacggcggccgcagtttcgcagcgctgcgtgacgaccccgtccggcgagcgatcgacgatgtggtggtgcggttcggctgtctgtcgaacgactactactcgtggggccgggagaagaaggcggtcgacaagtcgaatgcggtgcggatcctgatggaccacgccggctacgacgagagcaccgcgctggcccacgttcgcgatgactgcgtgcaggcgatcaccgacctggactgcatcgaggaatccatcaagcgaagcggccatctcggcagccatgcacaggagttgctcgactacctcgcatgccatcgaccgctgatctacgcagcggcgacctggccgacggagacgaaccgctaccgctgagcagcaaatcgcgccatcgaccccccacaaagagggccgtccctcctcgccctcggtgtacggatgaagggaaacctaccagcgatgagcactgccacctcttccagcgtcaccggctccgtcaccacccccagaaccgctacgactccgggcaggcgtcccggcctggctccgggtggcgtcccggtgctcgggcatctgccgatgatcctgcggtcccgtttcgagttcatcgaaacggtgcgcaacgcaggcccggtgacgcgggtcaagctgggcccgaagaccgcgtacttcgtcaacgactacgagctgctcgcccagatcctggtgagtgacgcggacaagttcgtgcgcggcatccacttcaagaagatgcggaacatggtcgggaacggcgtggtcacgacctccggtgacctgcaccgacggcaacggcggatcatgctcccgtcgttcagccagcgccggctggccatgcatctccccgtgatgcggaagatcatgtccgaattcgtcgcctcggtgcccgaacggcggccctatgacctgatggggccggtcatgggagtcggctgcgacatcgtgacctcgaccatgctcggcgagaagaccccgccggaggtcctgcgactcgtgcgcgaggccgtcccggtcttcgtcgagaacgccgcgatccaggccgtcgatgtgaccggcatctacaagcacctgccgacgaagtcgaaccgggacttcgaaaggctgctcaacgccttcaacgagtacatgtactcggtcatcgacgacaagttccgcaacggagccggtgaggaagccggcctcctcgacatgctgatcaacgcgaccgacccggagaccggcgagaagttcgaccggaccgaggtccgtgaccaggccgcgacgatcctgctggcgtcgacggagaccacggcgaacaccatcagctgggcctgctacgaactggcccggcacccgcggatcttcgccgaatgccgggcggagatcgacgcgctggtcaaggatcgtgactggctggacatcgagatcggtcggcacgatctgccggcgctcaagcgggtgctgttcgaggcgctgcgcatgtacccgtcctcgtacctcctctcgcggcaggcgtcggtggacacgacgctgggcggctacgccattccgaaggatgccgcgatcctgtactcgcactacgggcagcagcgggacgaacggaacttcccgcacggcgacgagttcgaccccgaccgctggctggacaaggacggcgccgaggtcacggcatccgcgttcatgccgttcgggttcggcgcgtaccgctgcctcggcgagagcgtggcggtgctggaggcgacctactgcctggccatgatggtccaccagtgggacttcgcgctcagcgactactcggagccgaagatgaacgcgacgatcacgctctccccgaaggacctggagttcctgttcaccaagcggacggagagcggagcgcacgatgagtgacctcgaggtgcgggtggaccgcgacctgtgcgtgggctccgggcagtgcctgatctctgccgccgactacttcgggcaggacatcgaggggtacgtggaactgctcccggacgccccgacggccgacctcgccacgaacgaagaggtgcaggaagcggtcgagaagtgcccctccggggcgttgtcctggcatcgcccggactaggacgtgcggcgaaagcgcatcctggtcgtgagtgatcacccgccgcaagacgtggggacctgacgaacgaccagtgggcccggcttgaaccgctgctgccgccgggcacaaagccgggccgtccaccggtgtggacccggcggcagctgatcgacggcacacggtgcggtcgagcagggacaagagccactgtcgctgctcgccgctgctggtcagcggcatgacagcccgcagttccagccggtcccggagggcatccgggcgccccgcaccggtcgaggccggccgcggacccggccggacaaggtccgcgccgacaaggcgtacggctcccgcgcgaaccgcacctgcctgcgcagacgcggcaggggcacgccacgcggtggagcgcgggatcaacaggctcaggcgccaccgggccgtggcggctcgatccgagaggctcgccgtccgttacgaggcgaccgtgctggtcgcagccctcaacgagtggctgtgaccagcactttcgccgcgccccagcgcgacctggatccgaggtccggccggcccgagctcgatgccgggccgcccgggccggatcc

SEQ ID NO: 601 - DNA, 2474 bp, Lactuca sativa
  copalyldiphosphate synthase No. 1
taaaggttataaatcgttacctcttcggtgcaaaagctgtgtttaaaagtacaaaatcctataatccaatcgccatgaagacaatgatctcctctccgattccagccttccacccccggttctctccggcggcaggttctcgtcgtctttctcccatccttccatccagtggcagtgtagtccttactggatcgaaaacccaatgcaaagccgtatcaaagtctcctacacaagaatactttgatgtacttcaaaaaaatggtttaccatttataaactggcagaatgacgtcgtggaggatgagttggataaagaaaagaagattttgtatcctaatgatgagatcaaagggtttgtcgagaggatcaaagtgatgttgggatcgatggatgagggagagataactgtatcagcttatgacacagcttgggttgcactcgttcaagatattgacggaaatggtcgccccgagtttccgtcaagtttagaatggatcgtgaaaaatcaactatctgacggatcatggggcgaccatttgatcttttcggctcatgaccggatcataaatacgttggcatgtgttatcgccctaacttcttggaacgttcatcccggtaaatgccaaaaaggactgaaatttctgaatgacaatataagcaaacttgaagaggaaaatccagaacacatgccgatcggttttgaagtagctttcccttcgctcattgacattgcaaggaaactagacattcaagtccccgaggattctcccgccttgaaagaaatctatgcaagacgaaacctgaagctcacaaagataccgaagagcttaatgcacaaagtgccaacaactttacttcatagcttggaaggaatgccagatttggagtgggaaaagcttctaaaattgcagtgcaaagatgggtcatttctgttttctccatcatctactgcttttgcactcatgcaaacaaaagatcaaaagtgtctgcagtatcttacagatgctgtcaccaaattcaatggtggagttccgaacgtgtacccagtggatctttttgagcatatttgggtcgttgatcgccttcaacgacttgggatttcgcgttatttcgattccgagataaaggattgcgttgactatatataccggtattggacgaaggacggaatttgttgggcgaagaactctaacgtacaagatattgatgacaccgcgatgggatttagggttttaagaatgcacggctataaagttactacagatgtatttcgacaattcgagaaagatggtaaatttgtgtgcttccctgggcaaacaacacaagcggttaccggaatgttcaatttatttagggcttcgcaggtgctcttccccgatgagaaaattctcgaagatgccaagaaattttcgtataactatttgaaggagaaacaatcgacaaacgagcttcttgataaatggatcatcgccaaagacttgccaggcgaggttgaatacgcattagatgtcccatggtatgcgagcttacctcgactcgaaacaagattttacttggagcaatacggaggtgaagacgacgtttggattgggaaaaccctatacaggatgggtaatgtgagcaataatacgtatcttgagatggctaaattggattacaataactgtctagcaatacatcacctcgaatggaacactatgcaacaatggtatgtggattttggtatggaacggtttgggacgagtgacatcacgagccttttggtgtcatactaccttgcagcggctagtgtattcgagccagaaagatccaaggaacggatagcatgggctaaaactactacattagtcgacaccatctcctcgtttttccactcactcaaaatctccaatgagcataggagagagtttgtagaggagttcagaaacatatccaattcaattcatcatgccaaatacgggaagccatggcatggattgatggttgcactgaaaggaaccctacacgagatcgctttggatgttcttatgactcatcgtagagacatccatccacagcttcaccatgcctgggagatgtggttgatgaggtggcaacaaggcgtagacgcaacggaaggacaagcggaactgatagtacaaacgataaacatgacggccggccgatgggtgtccaacgaactcttagcccatccgcaatacagactcctctcatccgtcattaataacatctgtcacgaaatataccacaatcgaacctgcatggaagtcaacagtacaactatcagcacgtcgatagattccaaaatgcaagaactcgtgcaactcgtgctcagcgactcactggatgatcttgatcaggatttaaagcagacgttcctcaccgttgcaaaaaccttctactacaaggcgtactgcgatcctgagacaattaatgttcatatttccaaagtaatgttcgaaacgataatttga

SEQ ID NO: 602 - DNA, 1832 bp, Lactuca sativa
  germacrene A synthase LTC1
tctcatcgagcttttctataccctttcaacttcaagaaatggcagcagttgaagccaatggtacccttcaagcaaacaccaaaaccaccacagagcctgtgcgtcctttggccaatttccctccttctgtatggggtgatcgtttcttgtcattctctcttgacaatacggaattggaaggatatgcaaaagccatggaggagcccaaagaagaagtgagaagattgatcgtagatccaacaatggattcaaataagaaactaagtttgatttattctgtacatcgacttggtttgacatatcttttcttgcaagagatagaagcacagcttgacaatattttcaaagcgtttaaattgcaagattatgatgaagttgatctatacacaacttctattaactttcaagttttccgacaccttggtcacaaactgccttgtgatgtgtttaacaaattcaaggacagcagctcgggtacattcaaggaatccattaccaacgatgtgaagggtatgctaggtctatatgaatgtgcgcaattgagattacgaggtgaatcgattctagatgaagcctcagcattcactgtaactcagctaaagagtgtagtaaacactcttgaaggaaaacttgcacagcaggtattacaatcattgaagagaccattccatcaagggatgccaatggttgaggcaaggttttatttctccaactatgatgaagaatgttccacacatgagtcgctagtaaagcttgcaaagctgcatttcaactatttgcagctacaacaaaaggaagaacttcgcattgtctcaaagtggtggaaggatatgaggttccaggaaactactccatatataagggatagagtaccagagatttacttatggattttgggattgtactttgagcctcgttattccttggcacgaatcatcgccacaaaaattacattgtttcttgtggtgctagatgacacatacgatgcatatgctaccatcgaagagattcgacttctaacagatgccataaataggtgggacattagtgctattgagcaaattccggaatacattcgaccattctacaaaattctcctagacgagtatgcggaacttgagaaacaactagctaaagaaggaagagcaaaaagcgtcattgctttaaaagaagcgttccaagacattgctagaggctaccttgaagaggccgagtggacgaacagtggttatgttgcatcatttccagagtatatgaagaacgggttagttacatctgcctacaatgttatttcgaaatctgccttagtgggtatgggtgagatggttagtgaagatgctttggcctggtatgagagtcatccaaagactttgcaagcttcagagttaatttcaagactccaagatgatgtcatgacttaccagtttgagcgagaaaggggtcaatcagccactggtgttgactcatatatcaagacgtatggcgtgtcagaaaaggaagctattgatgagctgaataaaatgattgaaaatgcatggaaggatataaacgagggatgccttaagccaagagaagtctctatggatttgcttgccccaattcttaatcttgcaagaatgatagatgtggtatacaggtacgacgatgggtttacttttccgggaaagaccatgaaagagtatattacccttttgtttgttggttcgtcacctatgtaataaattaataattgttgtttcatatttttgttgtttcatatgttcattacaattttcccaatgatgaataataaatatattgtggtcgggtatatcaatttaaaaaaaaaaaaa

SEQ ID NO: 603 - DNA, 1830 bp, Lactuca sativa
  germacrene A synthase LTC2
gctcaaccaatcaccattccacaaaacctgaagcttcacaaatcacaaaccccaattcaatttcaagaaatggcagcagttgacactaatgccaccatccaagaaaagaccaccgcagagccggtgcgtcctttagccaacttccctccttcggtatggggtgatcgcttcctatcattcactcttgacaattcggaactcgaaggatatgcaaaagccatggaagccccaaaagaagaattgagaagattgattgtagatcaaacaatggattcaaataagaaactaagtttgatttattccgtccaccgtcttggtttgacatatctgttcttgcaagagattgaagcccagctagacaaaattttcaaagagttcaacttgcaaaattatgatgaagttgatctttacacaacttctatcaactttcaagttttccgacaccttggttataaactaccttgtgatgtgtttaacaaattcaaagacaatacctccggcgctttcaaggaagatatttctacggatgtgaagggcatgctaggcttatacgaatcttcacaactaagaacaagaggagaatcgatactagatgaggcttcatcgttcactgaaactaaactcaagagtgtagtaaacaatcttgaaggaaatcttgcacaacaggtgttacaatcattgaggagaccatttcatcaagggatgccaatggtggaggcaaggctatatttctccaactatagtgaagagtgtgccacacatgagtgtttattaaagcttgcaaagctgcatttcagctatttggagctacagcaaaaggaagaacttcgcattgtctcaaagtggtggaaagatatgagattccaggaaactacaccttatataagggatagagtaccagagatttacttatggattttgggattgtactttgagcctcgttactccttggcacgaatcatcgccacaaaaattacattgtttcttgtggtgctagatgatacatatgacgcttacgctaccattgaagaaattcgacttttaactgatgccataaataggtgggacatgagtgctatggagcaaattccggaatacattagaccattctacaaaattctcctagatgagtatgctgagcttgagaaacaactagctatagaaggaagagcaaagagcgttattgcttcaaaagaagcgttccaagacattgctagaggctaccttgaagaagccgagtggacaaacagtggatatgtggcatcatttcctgagtacatgaagaatgggttaatcacttcagcctacaatgttatttcgaaatctgctttagtgggtatgggcgacatagttagtgaaaatgcattggcatggtacgaaagtcatccaaagactctacaagcttccgagttaatctcaagactccaagatgatgtcatgacttaccagtttgagcgtgaaagaggacaatcagccactggagttgatgcgtatatcaagacatacggcgtgtcagagaaggaagctattgatgagctaaagataatgattgaaaatgcatggaaagatataaacgagggatgtctcaagccaagagaagtctcgatggatttgctcgcgccaattcttaaccttgcaagaatgatagatgttgtgtatcgatatgatgatgggttcacctttcctggaaaaaccatgaaagagtatattactcttttatttgttggttctgtatccatgtaatgatacacaatcattgttgtttcatatgtttaatgtcataaaagaaatattaatcaataataattattgcaagtggcctcatgaaaa

SEQ ID NO: 604 - DNA, 1617 bp, Lavandula angusivolia
  (E)-alpha-bergamotene synthase
atggaggcgagaaggtcggggaatttcgagtccagcatctgggacgacgattacattcagtccctaacgagttcatatacgggtaaaatgtacgtagataaatctgagaagctgaaaattgaggtgaagatgatgatggacgaagcaacagatgagttggagcaactcgagcttatcaacgatctgcaaaggcttggtatatcttaccacttcaaagatggcatagctaagatgttgaacaacatttataagtcagatagcaaatacatggaaaaggacttgcacctcacagctctcaaatttagacttcttagacaacatggatatcgtgttcctcaagatgtttttagtagtttcatggatgatgaaggaaatttcgaggcctgggtggttgaagacgtgtcagttcttgtatctctgtatgaagcttcgcacatatcagtggaaggggagagcatattggatatggcgaaagatttctcatcgcatcatcttactgaaatggtggagcagattggtgaggcgtgtttagccgagcaagtgaagcgtacgttggagcttccactacactggagagttgggagacttgaagccagatggttcgtacaagcctacgagactagacccaactcaaaccccactctggtggagctagccaaactagatttcaacatggtacaagccaaataccaggatgagcttaaacgctgttcaaggtggtatgaagaaactggcctacccgaaaagatgagttttgccagacaccgattggcagagtgttttttgtggtctctgggatttataccagatcctcatcatgggtattcgagggagattatgaccaagattgcagtgctaattacgataacagatgacatatacgacatttatggagcgttagaagaacttcaagagttcacagaggcattcgagagatgggatatcaattcattggatctccttccagaatacatgcaaatctgtttcttagcaatcttcaactctgcaaatgaattgggttatcaaattctgagggaccaaggcctcaatattatcccaaatctgaagagatcgtgggcagaattgagtagagcttactacttagaagcaagatggtttcacaacggatttgtcccaactacagatcagtatctgaatactgcttggatttccatttcgggtcctctacttctttcctatggctacctcaccaccacgaatcccataaacaacaaggaactgaagagcctagaaaaacatcctagtatcatccgttggccatccatggttcttcgacttgcagatgatttgggaacttcatcagaagaaatcaaaagaggggatgtctcgaaatcaatccaatgctacatgaatgaaacaggatgctgcgagggggatgcccgacatcacgtaaagagtttgattgaggtagcattgaagcgaatgaacgatgagatattgatggagaagcccttcaagagtttcgacaccaacgccatgaatcttgcacgaatatctctctgcttctatcaatatggtgatggtttcgggaagccccactctgataccatcaagaacttggtgtcactcattgttctacccttccatatgccatga

SEQ ID NO: 605 - DNA, 2024 bp, Lycopersicon esculentum
  germacrene C synthase
aaaaaaagccaaaccttagaacaaacaagcaatggctgcttcttctgctgataagtgtcgccccttggctaattttcacccatctgtttggggatatcatttcctttcttatactcatgaaattactaatcaagaaaaagttgaagttgatgagtacaaagagacaattagaaaaatgctggtggaaacttgcgacaatagcactcaaaagcttgtgttgatagacgcgatgcaacgattgggagtggcttatcatttcgataatgaaattgaaacatccattcaaaacatttttgatgcatcgtccaaacagaatgataatgacaacaacctttacgttgtgtctcttcgttttcgacttgtgaggcaacaaggccattacatgtcttcagatgtgttcaagcaattcaccaaccaagatgggaaattcaaggaaacacttactaatgatgtccaaggattattgagtttgtatgaagcatcacatctgagagtgcgtaatgaggagattcttgaagaagctcttacatttaccaccactcatctcgagtctattgtctccaacttgagcaataataataactctcttaaggttgaagttggtgaagccttaactcagcctattcgcatgactttaccaaggatgggagctagaaaatacatatccatttacgaaaacaatgatgcacaccaccatttgcttttgaaatttgctaaattggattttaacatgctgcaaaagtttcaccaaagagagcttagtgatcttacaaggtggtggaaagatttggattttgcaaataaatatccatatgcaagagacaggttggttgagtgttacttctggatattaggagtgtattttgagccaaaatatagtcgtgcgagaaaaatgatgacaaaagtactcaacctgacctccattattgacgacacttttgatgcttatgcaacctttgacgaacttgtgactttcaatgatgcaatccagagatgggatgctaatgcaattgattcaatacaaccatatatgagacctgcttatcaagctcttctagacatttacagtgaaatggaacaagtgttgtccaaagaaggtaaactggaccgtgtatactatgcaaaaaatgagatgaaaaagttggtgagagcctattttaaggaaacccaatggttgaatgattgtgaccatattccaaaatatgaggaacaagtggagaatgcaatcgtaagtgctggctatatgatgatatcaacaacttgcttggtcggtatagaagaatttatatcccacgagacttttgaatggttgatgaatgagtctgtgattgttcgagcttccgcattgattgccagagcaatgaacgatattgttggacatgaagatgaacaagaaagaggacatgtagcttcacttattgaatgttacatgaaagattatggagcttcaaagcaagagacttacattaagttcctgaaagaggtcaccaatgcatggaaggacataaacaaacaattctcccgtccaactgaagtaccaatgtttgtccttgaacgagttctaaatttgacacgtgtggctgacacgttatataaggagaaagatacatattcaaccgccaaaggaaaacttaaaaacatgattaatccaatactaattgaatctgtcaaaatataaatataatgctgaaattgcaccttcatcatccaactattcacagcaaaataaggcatataataaattgaagactcacaacatatgagttgttaattcctgggatgtttgaaataaacaataattgtttttatttaatttgctaagccaaagtgaaatatacaacacttgagttgtattaaatcatgttttatctcatttccagcttgtgagtttggattattatattgttaattatcatcactttataatgtactgtaatcgtattgtatttgtattgtagtgttgtcataataaaatttgaataaaatatatttttgtttcaattccaaaaaaaaaaaaaaaaaaa

SEQ ID NO: 606 - DNA, 2018 bp, Lycopersicon esculentum
  delta-elemene synthase
aaaagcaaaccttagaacaaacaagcaatggctgcttcttctgctgataagtgtcgccccttggctaattttcacccatctgtttggggatatcatttcctttcttatactcatgaaattactaatcaagaaaaagttgaagttgatgagtacaaagagacaattagaaaaatgctggtggaaacttgcgacaatagcactcaaaagcttgtgttgatagacgcgatgcaacgattgggagtggcttatcatttcgataatgaaattgaaacatccattcaaaacatttttgatgcatcgtccaaacagaatgataatgacaacaacctttacgttgtgtctcttcgttttcgacttgtgaggcaacaaggccattacatgtcttcagatgtgttcaagcaattcaccaaccaagatgggaaattcaaggaaacacttactaatgatgtccaaggattattgagtttgtatgaagcatcacatctgagagtgcgtaatgaggagattcttgaagaagctcttacatttaccaccactcatctcgagtctattgtctccaacttgagcaataataataactctcttaaggttgaagttggtgaagccttaactcagcctattcgcatgactttaccaaggatgggagctagaaaatacatatccatttacgaaaacaatgatgcacaccaccatttgcttttgaaatttgctaaattggattttaacatgctgcaaaagtttcaccaaagagagcttagtgatcttacaaggtggtggaaagatttggattttgcaaataaatatccatatgcaagagacaggttggttgagtgttacttctggatattaggagtgtattttgagccaaaatatagtcgtgcgagaaaaatgatgacaaaagtactcaacctgacctccattattgacgacacttttgatgcttatgcaacctttgacgaacttgtgactttcaatgatgcaatccagagatgggatgctaatgcaattgattcaatacaaccatatatgagacctgcttatcaagctcttctagacatttacagtgaaatggaacaagtgttgtccaaagaaggtaaactggaccgtgtatactatgcaaaaaatgagatgaaaaagttggtgagagcctattttaaggaaacccaatggttgaatgattgtgaccatattccaaaatatgaggaacaagtggagaatgcaatcgtaagtgctggctatatgatgatatcaacaacttgcttggtcggtatagaagaatttatatcccacgagacttttgaatggttgatgaatgagtctgtgattgttcgagcttccgcattgattgccagagcaatgaacgatattgttggacatgaagatgaacaagaaagaggacatgtagcttcacttattgaatgttacatgaaagattatggagcttcaaagcaagagacttacattaagttcctgaaagaggtcaccaatgcatggaaggacataaacaaacaattcttccgtccaactgaagtaccaatgtttgtccttgaacgagttctaaatttgacacgtgtggctgacacgttatataaagagaaagatacatatacaaacgccaaaggaaaacttaaaaacatgattaattcaatactaattgaatctgtcaaaatataaatataatgctgaaattgcaccttcatcattcaactattcacagcaaaataaggcatataataaattgaagactcacaacatatgagttgttaattcctgggatgtttgaaataaacaataattgtttttatttaatttgctaagcaaaagtgaaatatacaacacttgagttgtattaaatcatgttttatctcatttccagcttgtgagtttggattattatattgttaattatcatcactttataatgtactgtaatcgtattgtatttgtattgtagtgttgtcataataaaatttgaataaaatatatttttgtttcaattcaaaaaaaaaaaaaaaaaa

SEQ ID NO: 607 - DNA, 2003 bp, Lycopersicon esculentum
  delta-elemene synthase
ctcgtgccgaattcggcacgagcttctgctgataagtgtcgccccttggctaattttcacccatctgtttggggatatcatttcctttcttatactcatgaaattactaatcaagaaaaagttgaagttgatgagtacaaagagacaattagaaaaatgctggtggaaacttgcgacaatagcactcaaaagcttgtgttgatagacgcgatgcaacgattgggagtggcttatcatttcgataatgaaattgaaacatccattcaaaacatttttgatgcatcgtccaaacagaatgataatgacaacaacctttacgttgtgtctcttcgttttcgacttgtgaggcaacaaggccattacatgtcttcagatgtgttcaagcaattcaccaaccaagatgggaaattcaaggaaacacttactaatgatgtccaaggattattgagtttgtatgaagcatcacatctgagagtgcgtaatgaggagattcttgaagaagctcttacatttaccaccactcatctcgagtctattgtctccaacttgagcaataataataactctcttaaggttgaagttggtgaagccttaactcagcctattcgcatgactttaccaaggatgggagctagaaaatacatatccatttacgaaaacaatgatgcacaccaccatttgcttttgaaatttgctaaattggattttaacatgctgcaaaagtttcaccaaagagagcttagtgatcttacaaggtggtggaaagatttggattttgcaaataaatatccatatgcaagagacaggttggttgagtgttacttctggatattaggagtgtattttgagccaaaatatagtcgtgcgagaaaaatgatgacaaaagtactcaacctgacctccattattgacgacacttttgatgcttatgcaacctttgacgaacttgtgactttcaatgatgcaatccagagatgggatgctaatgcaattgattcaatacaaccatatatgagacctgcttatcaagctcttctagacatttacagtgaaatggaacaagtgttgtccaaagaaggtaaactggaccgtgtatactatgcaaaaaatgagatgaaaaagttggtgagagcctattttaaggaaacccaatggttgaatgattgtgaccatattccaaaatatgaggaacaagtggagaatgcaatcgtaagtgctggctatatgatgatatcaacaacttgcttggtcggtatagaagaatttatatcccacgagacttttgaatggttgatgaatgagtctgtgattgttcgagcttccgcattgattgccagagcaatgaacgatattgttggacatgaagatgaacaagaaagaggacatgtagcttcacttattgaatgttacatgaaagattatggagcttcaaagcaagagacttacattaagttcctgaaagaggtcaccaatgcatggaaggacataaacaaacaattcttccgtccaactgaagtaccaatgtttgtccttgaacgagttctaaatttgacacgtgtggctgacacgttatataaagagaaagatacatatacaaacgccaaaggaaaacttaaaaacatgattaattcaatactaattgaatctgtcaaaatataaatataatgctgaaattgcaccttcatcattcaactattcacagcaaaataaggcatataataaattgaagactcacaacatatgagttgttaattcctgggatgtttgaaataaacaataattgtttttatttaatttgctaagccaaagtgaaatatacaacacttgagttgtattaaatcatgttttatctcatttccagcttgtgagtttggattattatattgttaattatcatcactttataatgtactgtaatcgtattgtatttgtattgtagtgttgtcataataaaatttgaataaaatatatttttgtttcaattcaaaaaaaaaaaaaaaaaa

SEQ ID NO: 608 - DNA, 2030 bp, Lycopersicon hirsutum
  germacrene B synthase
  variation 1721, 1723, 1773, 1832, 1850, 1859, 1880, 1882, 1894, 1901,1904, 1908, 1913, 1926, 1929, 1958, 1959, 1978, 1989, 1997, 2004,2008: n = a or g or c or t
aaaaagagcaaaccttagaacaaacaagcaatggctgcttcttctgctaataagtctcgtcctttggctaattttcacccaactgtttggggatatcatttcctttcttatactcatgaaattactaaccaagaaaaagttgaagttgatgagtacaaagagacaattagaaaaatgttggtggaagctcctgaaggtagtgaacaaaaacttgtgttgatagacgcgatgcaacgattgggagtggcatatcatttccataatgaaattgaaacatccattcaaaacatttttgatgcgcccaaacagaacaacaaccttcacattgtttctcttcgttttcgacttgtgaggcaacaaggacattacatgtcttcagatgtgttcaagcaattcaccaaccaagatgggaaattcaaggaaacgcttactaatgatgtccaaggattattaagtttgtatgaagcatcatatctgagagtgcgtgatgaggagattcttgaagaagctcttgcctttaccactactcatctcaaatctattgtctcaaccatgagcaataataataactctcttaaggttgaagttagtgaagccttaactcagcctattcgcatgactttaccaaggatggaagcaaggagatacatatccatttacgaaaacaatgatgcacacaaccatttgcttttgaaatttgctaaattggatttcaacatgctgcagaagttgcaccaaagagagcttagtgaccttacaaggtggtggaaagatttggattttgcaaataaatatccatatgcaagagacaggttggttgagtgttacttctggatattaggagtgtattttgagccaaagtatagtcgtgcgagaaaaatgatgacaaaagtactcaagatgacctccattattgacgacacttttgatgcttatgcaacctttgacgaactagaacctttcaatgatgcaatccagagatgggatgctaatgcaatcgattcaataccaccatatatgagacctgcttatcaagcttttctagacatttacagcgaaatggaacaagtgttgtccaaaaaaggtaaactggaccgcgtatactatgcaaaaaatgagatgaaaaagttggtgagagcctattttaaggaaacccagtggttgaatgattgtgaccatattccaaaatatgaggaacacatggagaattcactcgtaagcggtggttatatgatgataccaacaacttgcttggtcggtatggaagaatttatatccatagagacttttgaatggttaatgaatgatcctttgatagttcgagcttcctcattgatagccagagcaatgaacgatattgttggacatgaagttgaacaagaaagaggacatgtagcttcacttattgaatgttacatgaaagattatggagcttcaaagcaagaggcatacgccaaattcaagaaagatgtcaccaatgcatggaaggacataaacaaagaattcttccgtccaactgaagtaccaatgtttgtccttgaacgagttctaaatttgacacgtgcggctgaaccgttatataaagagaaagatgcatacacaaatgccaaaggaaaacttaaaaacatgattaattcaatactaattgaatctgtcaaaatataaatataatgctgaaattgccttccatcgttcaaatattcagagcaaaaataagggcntntaataaattggaagaacctttaattatgctactcacaccatattgagttngtaaattcctggggatgtttgaaataaacaataattggttttaattaatttattaagcnaaagtggaaatttccacncttggagtnggattaaatcatgtttaattnanttccacttgtangttgggnttntttnttggnaaatatcatcacnttntaatggacctggaaccgaatggatttggnntgggattgggggccataanaaaaattgaanaaaaaatntttttgnttcnaaaaaaaaaaaaaaaaaaaaaa

SEQ ID NO: 609 - DNA, 2000 bp, Lycopersicon hirsutum
  germacrene D synthase
gcacgagaacaaacaagcaatggctgcttcttttgctaataagtgtcgccccttggctaatttccacccaactgtttggggatatcatttcctttattataatcctgaaattactaaccaagaaaaaattgaagttgatgagtacaaagagacaattagaaaaatgttggtggaagctcctgaaggtagtgaacaaaaacttgtgttgatagacgcgatgcaacgattgggagtggcatatcatttccataatgaaattgaaacatccattcaaaacatttttgatgctcccaaacagaacaatgatgacaaccttcacattgtttctcttcgttttcgacttgtaaggcaacaaggacattacatgtcttcagatgtgttcaagcaattcaccaaccaagatgggaaattcaaggaaacacttactaatgatgtccaaggattattgagtttgtatgaagcatcacatctgagagtgcgtaatgaggagattcttgaagaagctcttacatttaccaccactcatctcgagtctattgtctccaacttgagcaataaaaataactctcttaaggttgaagttagtgaagccttaagtcagcctattcgcatgactttaccaaggattggagctagaaaatacatatccatttacgaaaacaatgacgcacacaaccatttgcttttgaaatttgctaaattggattttaacatgctgcaaaagtttcaccaaagagagcttagtgatcttacaaggtggtggaaagatttggattttgcaaataaaattccatatgcaagagacagattggttgagtgttacttttggatattaggagtgtattttgagccaaaatatagtcgtgcgagaaaaatgatgacaaaagtactcaagatgacctccattattgacgacacttttgatgcttatgctaactttgacgaacttgtgcctttcaatgatgcaatccagagatgggatgctaatgcaatcgattcaataccgccatatatgagacccatttatcaagctcttctagacatttacggtgaaatggatcaagtgttgtccaaagaaggcaaactggaccgtgtatactatgcaaaatatgagatgaaaaagttggtgagagcctattttaaggaatcccaatggttgaacgatgataatcatattccaaaatatgaggaacacatggagaatgcaatcgtaactgttggctatatgatgggagcaacaaattgcttggttggtatggaggaatttatatctaaagagacttttgaatggttgatgagtgagcctgtgattgttcgagcttcctcattgatcggcagagcaatggacgatattgttggacatgaagttgaacaagagagaggacatgtagcttcaattattgaatgttacatgaaagattatggagcttcaaagcaagaggcttacgccaaattcaagaaggatgtcaccaatgcatggaaggacataaacaaagaattcttccgtccaactgaagtaccaatgtttgtccttgaacgagctttaaatttcacacgtgtgatagacacgttgtatcaagaggaagatgaatatacaaacgccaaaggcaaacttaaaaacatgattcactcgatactgattgaatctgtcaaaatataaatataatgatgaaattgcaccttcatcattcaaatattcagagcaaaataaggcacatacaataaattgaagacctttaatatgctattcataatatatgagctgttaatgaaataaacaatagttgtttttaatttacttagcaaaagtgtgattggtttgtctttttcctgttttcaaaaaatatacaacactcagagttgtattaaatcctgttttatttcatttccagcttgttggatgattgttaattatcatcactttataatgtattgtatttatattgtattgttatcgtaataaaatttgaataaattatatctttaaaaaagaaaaaaaa

SEQ ID NO: 610 - DNA, 2339 bp, Magnolia grandiflora
  beta-cubebene synthase
atggatagtcccactactcaaaggccaaacatggagattggtcgtgcttttgtaaattatcaccctagtatctggggtgaacacttcattgcagcctctccagatgtcatggtatatcgatattcgtgtgctagttctttggcttgtaaatgtgatagtacagtacacactttctgaaaaaaaaaaagaaaagtgtagaattcttggtggaatgcatgcacacaaagaaagagatctgccacgaattgtttagcctgttctgcgagtcaggatagccagcatatgccaccccttaggatccgcatccatgtcaatgatctgaactttccttcttctcaatgaaagttctcctaacctttttcttagaatcatctgtttactgtaattttcttatcagaccatctcagcttatgctaatcctgagatgcccaaatgggaaaaccagttctcctctgaaacatcattacacatgtttttcaaacaagatttatcctaattgacttttggattaattaggctttcttttgtttacacatgcacttggggtttaaatctgaagtaatatcaaaatgtgttctatgaatattctttgaagaattattttggaactttttaacaatctttgttgttattcatttaaatattgtctatttcctaggtattctgaaaatgatgtgctttatggtttctccataagccattaaaagatgccaaatttctgttctttttcaaaatgatgtaatatttgccttgattttattttttatttttttcctctaaacttggtgttaaagcagaggttggacgcacataaaggacgtggtgaagaattgaaggaagtagtaaggaatatgtttagcacggtcaatgatccattgctcaaaatgaatttgattgatgcaattcaacgccttggtgtagcctaccactttgaaatggagatagataaggcattgggccagatgtatgatgaccacatcaatgggaaggacgatggttttgacctccaaacccttgctctccaatttcgactacttaggcaacaaggttataatgtctcatccggtgtgtttgcaaagttcaaggatgatgagggaaatttcagttcaatattaagcaaggacacgcacggtttattaagtttatatgaagccgcattccttggtacacatggggatgatatattggatgaagccattactttcaccacagtgcacctcaaatccacattgccgcatgtgagtgctcccctgacaaagctagttgaacttgccttagaaataccacttcacaggcgcatggagaggctacagacaaggttctatatctcgatttatgaggaagacagggaacgaaacgatgtgctactggagttttcaaagttagagtttcttaggttgcagtcattgcaccagagggaacttagagacatatcattgtggtggaaagaaatggaccttttagcaaagcttccattcaccagagatagagtgttggaaggctacttttggacagtaggagtgtactttgaaccacattattcccgagctagaatgataatgacaaaaatgatagcatttgcaacagttatggatgacacctatgacgtatatggtacattggaggagcttgaactacttactgctacgatcgaaaggtggaatcgtggagatatggatcaactgccagactacatgaaagtgatttttattgcactcttagatggggtcgatgcaactgaggatgatctaactggggagggaaaatcataccggatatactacttaaaggaagcggttaaggatctggccaaagcctacttagctgaagcaagatgggtcagctcggggtatgttccaacctcagaggagtacatgaaggttgccttaataagcgctgtttatcctatgctttttgttgcatttctcattggcatggatgaagtcgtgacaaaggaggtccttgagtgggccatacacatgccaacgatgctgaggacttgttctattgtggcccgattgatggatgacatcccatcaaacaagcttgagcaagaaaggaagcatgtttcatcctcagtagagtgctacatgaaagagcatggaacctcctaccatgaaagtattcaaaagcttcgggaaatggttgcaagtggatggaaagacatcaacaaggaatgtcttaaaccgactccagtacctacggctgtgatcaatgttatcctgaattttacacgtgtgctcgaaatcatataccaacatcgagatggatatactgatgcaagcgttgagaccaaagaacatattgcatcactgtttgtggaccctattccactttaa

SEQ ID NO: 611 - DNA, 1931 bp, Malus x domestica
  (E,E)-alpha-farnesene synthase
ttcttgtatcccaaacatctcgagcttcttgtacaccaaattaggtattcactatggaattcagagttcacttgcaagctgataatgagcagaaaatttttcaaaaccagatgaaacccgaacctgaagcctcttacttgattaatcaaagacggtctgcaaattacaagccaaatatttggaagaacgatttcctagatcaatctcttatcagcaaatacgatggagatgagtatcggaagctgtctgagaagttaatagaagaagttaagatttatatatctgctgaaacaatggatttagtagctaagttggagctcattgacagcgtccgaaaactaggcctcgcgaacctcttcgaaaaggaaatcaaggaagccctagacagcattgcagctatcgaaagcgacaatctcggcacaagagacgatctctatggtactgcattacacttcaagatcctcaggcagcatggctataaagtttcacaagatatatttggtagattcatggatgaaaagggcacattagagaaccaccatttcgcgcatttaaaaggaatgctggaacttttcgaggcctcaaacctgggtttcgaaggtgaagatattttagatgaggcgaaagcttccttgacgctagctctcagagatagtggtcatatttgttatccagacagtaacctttccagggacgtagttcattccctggagcttccatcacaccgcagagtgcagtggtttgatgtcaaatggcaaatcaacgcctatgaaaaagacatttgtcgcgtcaacgccacgttactcgaattagcaaagcttaatttcaacgtagttcaggcccaactccaaaaaaacttaagggaagcatccaggtggtgggcaaacctgggcatcgcagacaacttgaaatttgcaagagatagactggttgaatgtttcgcatgtgctgtgggagtagcattcgagcctgagcactcatcttttagaatatgtcttaccaaagtcatcaacttagtactgatcatagacgacgtctatgatatttatggctcagaggaagagctaaagcacttcaccaatgctgttgataggtgggattctagggaaactgagcagcttccagagtgtatgaagatgtgtttccaagtactctacaacactacttgtgaaattgctcgtgaaattgaggaggagaatggttggaaccaagtattacctcaattgaccaaagtgtgggcagatttttgtaaagcattattggtggaggcagagtggtataataagagccatataccaacccttgaagagtacctaagaaacggatgcatttcatcatcagtttcagtgcttttggttcactcgtttttctctataactcatgagggaaccaaagagatggctgattttcttcacaagaatgaagatcttttgtataatatctctctcatcgttcgcctcaacaatgatttgggaacttccgcggctgaacaagagagaggggattctccttcatcaatcgtatgttacatgagagaagtgaatgcctctgaagaaacagctaggaagaacattaagggcatgatagacaatgcatggaagaaagtaaatggaaaatgcttcacaacaaaccaagtgccttttctgtcatcattcatgaacaatgccacaaacatggcacgtgtggcgcacagcctttacaaagatggagatgggtttggtgaccaagagaaagggcctcggacccacatcctgtctttactattccaacctcttgtaaactagtactcatatagtttgaaataaatagcagcaaaagtttgcggttcagttcgtcatggataaattaatctttacagtttgtaacgttgttgccaaagattatgaataaaaagttgtagtttgtcgtttaaaaaaaaaaaaaaaaaaaaa

SEQ ID NO: 612 - DNA, 1662 bp, Medicago truncatula
  (-)-cubebol synthase
atgtctactgtagcttactctgatcatgacgccaagcaaagaaatcttgcagattatcacccaagcgtttgggggggtttcttccttcagtatgcttcagaaaccatggaacttgatcagaatcttgcatcacaaattgatacgttgaaagatgaagtgagaaacatgcttgtctcaaagactgagatgcccttgacaaaagtcaaattgattgattcaatatgtcgtttgggtgttggttatcattttgaaaaagagattgatgaagttttgcaacatattcacaaaagttatgttgaaaatggagaaataacgcttgaagacagcctgtgctctcttgccatgctatttagggtgttcaggcaacaaggacttcacgtttcaccaaatgtgttcaacaaatttaaagacaagcaaggaaactttaatgaaaatcttagcacggatgttgaggggatgttaagcttgtatgaagcatcacatatgatggttcatgaagatgacattttagaagaagcattaaatttcacttcaactcacctcgagtccattgcctctcaatcgagcccttcacttgctgcacaaatcgaatataccttaaagcaggctctccacaaaaacataccaaggctagaggcacgacactacatttctatctatgagaaagatcctacctgtgatgaagttctactcactttcgcaaaattggatttcaatttactccaatccctacatcaaaaagagtttggaaacatttccaaatggtggaaggagttggacttctctaccaaactaccttatgcaagagataggatcgcggaatgtagcttttgggttttgactgcattttttgaaccccaatattctcaagcaagaaaaatgatgattaaagtaatcaccctactttcaatcattgatgatacatatgatgcatatggaacaattgatgaactggaactttttaccaaggcagttgaaaggtgggatattagcagcttggacgaacttccagactacatgaaacctatctatagatcattcttaacaatttacgaagaaatagagaaagaaatgagaaaagaaggaaggatatatacccttgactactacaaaattgaattcaaaaagtcagtgcaagcatttatgacagaggcgagatggctgaatgaaaaccatataccaacaacagaagagtacatgcgcatatcaaaaaaatcaggtgcttaccctttgctgatattaacctcttacattggtatgggtgacatagccacaaaggagatcttcaattgggtatcaaatgagccaagaattgttaacgccgctgcaactctttgcaggctaatggatgaaattgtttccagcgagtttgaacagaaaagaggacatgtttgctcattgttagattgttatatgaagcaatttgatatgtcgagagaagctgctattcaagaatgcaaaaatagaatgacaattgtttggaaagatataaatgaagaatgtcttaggccaaccgaagttccgatgccttttatgactcgtgttcttaatctttcacgttttatggatgttatttacaaaaacaaagataactacacggattctgacggactaatgaagacatgtattaaagaagtgttggttgatcctgttccaatttga

SEQ ID NO: 613 - DNA, 2092 bp, Medicago truncatula
  (E)-beta-caryophyllene synthase
attgaagtactactatttgtttgagtcatttatcttactatccaataatccaaaatagttggaaacaaattaaggtagtaattaccccacaaataaaatcatgtcggtttcagtaacatcatcactagttgctccaacccctaatgctaactccgatttctctagacgttctgcaaattatcaccccaacatttggggggacctttttattcaatatgttttggaacctatggaatttgatgaaataatgaagcagattataatgctaaaagaaaaggtgaggcagatgctagtccctaacgtaaatgtcacaaacccttcgagggaagctaatttgattgattcaatccaacgtttgggattataccatcattttgagcaagagattggagaattattgcgacatattgacaataatcatgttgaaaatggaacaataactcttaacgaagaccttcattcaattgcacttgtctttaggttactaaggcaacaaggatatcacattttgcctgatgtttttaagaagttcaagaatgagcaaggaaacttcaaagaaacacttgttggtgatgttgaggggatgctaagtttgtatgaagccacacatatgaggattcatggagaggagatattagatgatgcactttctttcacttccttacaccttgaaatgatgaccactcaattgagtccttctgttgctacaaaaatcaatcatagcttaaagcggccactcttcaagaacttgcctaggcttgtggcaaggcattacatttccacttatgaggaagatccatctcatgatgcaactttgctattacttgccaaattagatttcaatttgcttcaaaaacaacatcagaaagaagttggcgatatttcaaagtggtggaaagatttagattttgcaacaaaactaccttttgctcgcaatagaatagttgaagcttacttttggatattgggagtgtattttgagcctcaatactcttttggtagaagaataatgaccaaggtgatatccttggcctcagtaattgatgacatatatgatgtttatggtacaatagaagagctacaacttttcactcaagcaattgaaaggtgggatataagttgcatggattttctaccacaatacatgaaattttgttataaagccgttttggatgtttatgaagaaatggagcaagagatggtcaaggaaggcagagcattttgtgtattctatgccaaaaatgaaatgaaaagattggtccaggcatactttactgaggctaaatggttcagtagaaattatataccaacagtggatgaatacatggctcttggaatagtaaattctggttactatctaatcacagcaacatccttcattggaatgggatgcattgctacagaagatgttttccaatggttaaccaataaccccaaaattgtcaatgcttcatctaaaattgctagactcatggatgatattgtttccaatgagtttgagcaagagagagggcatggtgcctctgctattgagtgctacatgaatgaacatggtgtgtctagagaagatgcagttaatgaactttcaagacaagtcacaaatgcttggaaggatacaaatgaggaacttcttgatccaactgaagtgccaaagcctctacttatacgagttctcaatttgtcacgtgtcattgatgtgctttataaagatggagattgctacactaactcccaaggatcaacaaagaatgacataatatctatcttgttgaatccatgtccagtatgagtaaagggacttcgctagcttcttcacttgtccatcttctactattagctatggagttttcagttatgggtaattagttagctggttagacttttttttaagaagacaaactagttgctggaattgacataagaatgaatcgaacctgaaattttaaaaggaatacattccaaaatctcaaatcaacgcattctaagttatagttgttacttgttagttagactaattatagtcgatttcattttgattatataagataaattgtacttctttatataataaaaattatgtccttatctctta

SEQ ID NO: 614 - DNA, 2076 bp, Medicago truncatula
  3S-(E)-nerolidol synthase
ggcacgaggaaatctatggctttttctctttctttcgctacttcaaccaaacattcaacgttttcttcaaacaaaacctcaaatattttggagtataataaaaccaatttaacttctgtcttcaatcaaattcatattcctaaaagtggtaaatgcaaggatgaccttcatataagacatgctaaagcattggatgaagttaagcaggtatttgttagaaatataagaaaaaatacggacgaatgtttatctatggtggattccatccaaagattaggcatggagtacaattttgaagaggaaattgaagcaacacttgaaaggaagcacactatgcttagatttcagaatttccagagaaatgaatatcaaggactgtcacaagctgcatttcaatttcgtatgttgagacaagaagggtattacattagcccagacatatttgataagttttgtgacaacaaaggcaaactcaagtatacattttctgaggatataaatggaatgattgcattgtttgaagcttctcaattgagcatagaaggagaagactgtcttgacaatgtaggacagttctgcggccaatatcttaatgactggtcatcaacatttcatggccaccctcaagccaaatttgtggcacacactttgatgtatccaactcataaaactttgtcaagattcacaccaacaataatgcaatcacaaaatgcaacatggacaaactctatacagcaattttcaaaaatagacactcaaatggtttcctcttcacatctcaaagaaatttttgctgtttccaaatggtggaaagacttaggtttgccaaaggacttggaatttgctagagatgaaccaattaaatggtactcgtggtcaatggcatgtctcccagatccacaattctctgaagaacggattgagctcacaaagcctctatccctaatttacatcattgatgatatatttgatttttatggaaacattgatgaacttactctctttacagatgctgttaagagatgggacttgtcagctattgaacaattaccagactgcatgaaagtgtgtttcaaggctctttatgacataactaatgaatttgctcttaggacatacatcaaacatggatggaatcctttaacctcattaataaaatcgtgggtaagactcttgaatgctttcttgcaagaagcaaaatggtttgcttctgggaatgttccaaagtcagaggagtatttgaagaatgccatagtaagcactggggtacacgtgatacttgtgcatgctttcttttgcatgggtcaaggtataactgagaaaaccgtgtctctaatggatgacttcccaaccattatatctacaacagccaaaattctaaggctatgtgatgacttggaaggcgataaggatgttaattgtgagggtaatgatgggtcgtattcgaagtgttacatgaaagataacccaggagtttctattggactaacaaaggagcatatgagtgaacaaatttcagatgcatggaaacaactcaacaaagaatgtttgaacacaaatccattaccctcatcttttactaaactttgtctcaatgctgcacggatggtaccaataatgtacaattatgatgggaatactccttcaaagctagaggagtatgtgaaatcgttgcttaatgatggtggttacttacaaagtattcattccccaacatcagagcattctacagtatgagcattcaaattttgtgaagtagctagtctcaccttcatacacatactactagagagaatcaccaaattacaatgaaatttatgtattacttacttaacaattgagtgcatgtttgaaattacggtaagtttcctgattttaccgaacccaagtcacataaagtgtgaatgtacagtcatatgtgcttgggacttgggagttaggagcaaaatcgatatagtccttgtttggttgtttgggagctgggaattaggaggaaaagcatatagaccttctggaggagggggaaagagaaagatatttttcattatttgagattaatgtttgaaagggaagcta

SEQ ID NO: 615 - DNA, 1656 bp, Mentha x pipereta
  (Z)-muurola-3,5-diene synthase
atggctacaaacggcgtcgtaattagttgcttaagggaagtaaggccacctatgacgaagcatgcgccaagcatgtggactgataccttttctaacttttctcttgacgataaggaacaacaaaagcgctcagaaaccatcgaagcacttaagcaagaagcaagaggcatgcttatggctgcaaccactcctctccaacaaatgacactaatcgacactctcgagcgtttgggattggctttccattttgagacggaggtcgaatacaaaatcgaacaaatcaacgccgctgcagaagacgacggctttgatttgttcgctacagctcttcgttttcgtttgctcagacagcatcaacgccacgtttcttgcgatgttttcgacaagttcgtcgacaaagatggcaagtttgaagaatcccttagcaataatgttgaaggcctattaagcttgtatgaagcagctcatgttgggtttcgcgaagaaaggatattacaagaggctgtaaattttacgaggcatcacttggaaggagcagagttagatcagtctccattattgattagagagaaagtgaagcgagctttggagcaccctcttcatagggatttccccattgtctatgcacgccttttcatctccatttacgaaaaggatgactctagagatgaattacttctcaagctatccaaagttaacttcaaattcatgcagaatttgtataagaaagagctctcccaactctccaggtggtggaacacatgggatctgaaatcgaaattaccatatgcaagagatcgagtggtggaggcttacgtatggggagtgggataccattacgaacctcagtactcatatgttcgaatgggacttgccaaaggcatactaattattggaatcatggatgatacttatgataattatgctacactcaatgaagctcaactttttactcaagtcttagacaagtgggatagagatgaagctgatcgactcccagaatacatgaaaatcgtttatgaatttattttgagtacatgtgaaaattatgaacgtgatgcagcgaaacttggaaaaagctttgcagctccttattttaaggaaaccgtgaaacaactggcaagggcatttaatcaggagcagaagtgggttatggaaaggcagctaccgtcattccaagactacgtaaagaattcagagaaaaccagctgcatttataccatgtttgcttctatcatcccaggcttgaaatctgttacccaagaaaccattgattggatcaagagtgaacccacgctcgcaacatcaaccggtatgatcggccgatattgggatgacatcggctctcacctccgcgaaagcaaaggaggggaaatgctgactgcgttggatttccacatgaaagaatatggtctgacgaaggaagaggcggcatctaagtttgaaggattggttgaggaaacatggaaggatataaacaaggaattcatagccacaactaattataatgtgggtagagaaattgccatcacattcctcaactacgctcggatatgtgaagccagttacagcaaaactgacggagacgcttatttagatcctaatgttgccaaggcaaatgtcgttgccctctttgttgatgccatagtcttttga

SEQ ID NO: 616 - DNA, 1959 bp, Mentha x pipereta
  (E)-beta-farnesene synthase
aaactctgcaatttcatatataacatcataaaatcagagagagagacagagagtttgttgtagtgaaaaaatggctacaaacggcgtcgtaattagttgcttaagggaagtaaggccacctatgacgaagcatgcgccaagcatgtggactgataccttttctaacttttctcttgacgataaggaacaacaaaagtgctcagaaaccatcgaagcacttaagcaagaagcaagaggcatgcttatggctgcaaccactcctctccaacaaatgacactaatcgacactctcgagcgtttgggattgtctttccattttgagacggagatcgaatacaaaatcgaactaatcaacgctgcagaagacgacggctttgatttgttcgctactgctcttcgtttccgtttgctcagacaacatcaacgccacgtttcttgtgatgttttcgacaagttcatcgacaaagatggcaagttcgaagaatcccttagcaataatgttgaaggcctattaagcttgtatgaagcagctcatgttgggtttcgcgaagaaagaatattacaagaggctgtaaattttacgaggcatcacttggaaggagcagagttagatcagtctccattattgattagagagaaagtgaagcgagctttggagcaccctcttcatagggatttccccattgtctatgcacgccttttcatctccatttacgaaaaggatgactctagagatgaattacttctcaagctatccaaagtcaacttcaaattcatgcagaatttgtataaggaagagctctcccaactctccaggtggtggaacacatggaatctgaaatcaaaattaccatatgcaagagatcgagtcgtggaggcttatgtttggggagtaggttaccattacgaaccccaatactcatatgttcgaatgggacttgccaaaggcgtactaatttgtggaatcatggacgatacatatgataattatgctacactcaatgaagctcaactttttactcaagtcttagacaagtgggatagagatgaagctgaacgactcccagaatacatgaaaatcgtttatcgatttattttgagtatatatgaaaattatgaacgtgatgcagcgaaacttggaaaaagctttgcagctccttattttaaggaaaccgtgaaacaactggcaagggcatttaatgaggagcagaagtgggttatggaaaggcagctaccgtcattccaagactacgtaaagaattcagagaaaaccagctgcatttataccatgtttgcttctatcatcccaggcttgaaatctgttacccaagaaaccattgattggatcaagagtgaacccacgctcgcaacatcgaccgctatgatcggtcggtattggaatgacaccagctctcagctccgtgaaagcaaaggaggggaaatgctgactgcgttggatttccacatgaaagaatatggtctgacgaaggaagaggcggcatctaagtttgaaggattggttgaggaaacatggaaggatataaacaaggaattcatagccacaactaattataatgtgggtagagaaattgccatcacattcctcaactacgctcggatatgtgaagccagttacagcaaaactgacggagacgcttattcagatcctaatgttgccaaggcaaatgtcgttgctctctttgttgatgccatagtcttttgatttgcataatcaaagaccctataattataattatatgtgtttaagaaactaataagcttgctttatgtatagttgtcaattgaataataatgtattaattagtagagttaagaagttataaagaataaagaggagctggtagacgtaaacaagaaataatgtgtcaaaataacttcaactttttcaagaataaagaattggaagagaccaatatatacaaaaaaaaaaaaaaaaaa

SEQ ID NO: 617 - DNA, 1898 bp, Mikania micrantha
  beta-caryophyllene synthase
acgcggggaccacaacacaatttgagaagatagttccaattaagcatacatttaagcatgggttgtaagcaagaatccttccggccctttcgtagcacttctccaagtgtttggggggatatgtttcttaactacgaaaagaaagcagagcaatgtgatgtagaacttacagttgaagacttgaaagaaaaagtgagagaagctataacaggagctttaggcaatccaaaagaacatgtgaatttgctaaaactaattgatgcaatccaacgccttggtataccgtattattttgaagatgagattacaaatgctttgcaacatctttatgaagcatatggtgatgagtgggttggtggtagcccttcaatttggtttagactcctacgacaacacggcttctatgtttcatgtgatatttttaacaagtactataaggacaaacatggagattttaaggaatcattaatcaatgatgatgaagaaatggtcgagctatatgaggcaacaagcttgagggtacggggagaagttgtactagacgaggcatttgaatttacaagaaatcattttgctaacatagctaaggaaccccgttgtagcaacgccactttgtcaacccatatacaggtggcattagagacacctttgcataaaaggataccaagattagacgcgttgcgttacatacgcttctatgaaaaacaagcttctcataatgaaagtttacttaaacttgccaagttagggttcaacttacttcagtcactacacaggagcgagcttagccaagtttctaagtggtggaaagatgttgatgtccaaaagaatttgccttatgctagagacagaatggttgaaagttacttttgggcaattggtgtatactctgagcctaaatattctcttggtagagtttttttagcaaaagtgattcaattggcgactgctatagatgacacttttgatgcttacggtacttatgaagaactccaaacttttactagggcagttgaaaggtggagcattacatgcttagatgagcttccagagtatatgaaactcttgtaccaagttttactggatttatacggagaaatggaaccaatcatggaaaaggaacaattaacacctctatttaattgttcaaaagagtttatgatagagactgttaaagcctacatggtggaagcaaaatgggtatatgaggggcacataccaactaaagatgaacatacatcaattgcattcgcaacaggtggtggtcccttgttgatgtcgtcttgctatctgggcatgggtgatataatcacgaatgattcgatcaattgggttattagtgaacctcctcttttgaaagctacaaatatgattggaagattactaaatgatattgtgtcctctaagaaggagcaagaaagagtgcatttccagtctattgttcaatgctacaagaaacagtatgatgtgagtgaggagcatgccattaacctggtgagggaggaaattgaggacgtttggaaagatatcaacaaggattcactcaccgccaaagatgttccaaggcctctcatactagttgtggtcaactatgcacgaacattgtattatttgtacaagtataatgataatttctttgaagtggaagaagacatcaaagaggatatcaaatcattgctcattcatcctatgagcatatgataattaacttttatgaggcaagccgttcaacctcctggtggattatgcacgtttgattttaatctaataataattttagttaatgttatgtgtattgtgttggactttaaataatatccccctgtatttttatgttttactaataaataaattgtgtttttgcttcaaaaaaaaaaaaaaaaaaaaaaaaaaaaaaa

SEQ ID NO: 618 - DNA, 1869 bp, Nicotiana attenuata
  5-epi-aristolochene synthase
caatggcctcagcagcagttggcaactacgaagaagaaatcgttcgtcccgtcgccgacttctcccctagtctctggggtgatcacttcctttcattctccattgacaatcatgttgcgcaaaagtatgctcaagagattgaaccattgaaggaacagacaagaagtatgctggtagcaaccggaagaaaattggttgacacattgaatttgatagacaccattgaacgccttggcatatcttatcactttgagaaagaaattgatgagattttggatcaaatttacaaccaaaactcaaacagcagtgatttgttcacttctgcacttctttttcggttgctcaggcaacatggtttcaacatctctcctgaaattttcagcaaattccaagacgaaaatggcaaattcaaggaatcacttgctagtgatgtggtaggattattgaacttgtatgaagcttcacatgtaaggactcatgctgacgatatcttagaagccgcacttgctttctccactatccatcttgaatctgcagctccacatttgaaatctccacttagggagcaagtggcacatgctcttgagcaatgtttgcacaagggcgttcctagagttgagacccgattcttcatctcatcaatatatgagaaggaacaatcgaaaaataatgtgttacttcgatttgctattttggatttcaacttgctccagatgttgcacaaacaagaacttgctgaagtatcaaggtggtggaaagatttggatttcgtaacaacacttccatatgctagagatcgagtagttgaatgctacttttgggcattaggagtttattttgagcctcaatactctcaagctcgtgtcatgctcgttaagaccatatcaatgatttcgattgtcgatgacacctttgatgcttatggtacagttaaagaacttgagacatacacagatgccatacaaagatgggatatcaatgaaattgatcggcttcctgattacatgaaaatcagttataaagctattcttgatctttacaaggattatgaaaaggaattgtctagtgctggaagatctcatattgtgtgccatgcaatagaaagaatgaaagaagtagtaagaaattataatgtcgagtcaacatggtttattgaaggatatatgccacctgtttctgaatacctaagcaatgcactggcaactactacatattactaccttgcgacaacatcatatttgggtatgaagtctgcgacagagcaggattttgagtggttgtcaaagaaccctaaaattcttgaagctagtgtgattatatgccgagttattgatgatacagcaacgtacgaggttgagaaaagcagaggacaaattgcaacagggattgagtgttgcatgagagattatggtgtatcaacaaaagaggcaatggataaattccaacaaatggctgagacagcatggaaggatcttaatgaaggacttcttaggccaactccagtatctgcagagcttttaactcctattctcaatcttgctcgtattgttgaggttacatatatacacaatctagatggatatactcatccggagaaagtcttaaaacctcacattattggcctacttgtggactctatcgatatttgagctgccaattgttgctcatcttaaggaaactacattcttctttgttgagaaagtagttatataagtttaattttttcgttttattgtataattaagttgttggggagctgcttttgcgattgtgcagtgcacttcctaactaggatctccttaattaagatccttgtaagaaataatctacaaagtgttagaatccaaaaaaaaaaaaaaaaaaaaaaaa

SEQ ID NO: 619 - DNA, 3063 bp, Nicotiana tabacum
  5-epi-aristolochene synthase
attatacccagcctctccgaacccgggttttgaagatcaatgctgaccgaaccaggcggcggtacgtcatccgcttgagggtagagacggatcagttcttgttgtcgtgtgtcgagctcgggacgtttgtcacatggctggacgggttattcgccgccatcaacgtgtcgccgccaatcgacgagcgcgactttcccagagactttagcgtgccacggatcaattacattaactagtctctcaccactatatatacttgtcccttctcttccatttaagtagagttcctttctttcttccttaaaacttaaaagaacaagtaaaaatacactcatctttaattagcaatggcctcagcagcagttgcaaactatgaagaagagattgttcgccccgtcgccgacttctcccctagtctctggggtgatcagttcctttcattctccattgataatcaggtaatttaactaatactagtattctttatttatatttatagtttgttctccattgataatcaggtagtttatttatgttgaacaacattaattttgctaatttcagtttaatgtacattacatataggttgcggaaaagtatatatatgctcaagagattgaagcattgaaggaacaaacgaggagtatgctgttagcaaccggaaggaaattggccgatacattgaatttgattgacattattgaacgccttggtatatcctaccactttgagaaagaaattgatgagattttggatcagatttacaaccaaaactcaaactgcaatgatttgtgcacctctgcacttcaatttcgattgctcaggcaacacggtttcaacatctctcctggtaagttcatcatgaagttgttaaaattattatccatttattggaagaaggctaattcatcttgagttttctttcttgaaataccagaaattttcagcaaattccaagatgaaaatggcaaattcaaggagtctcttgctagtgatgtcttaggattattaaacttgtatgaagcttcacatgtaaggactcatgctgacgatatcttagaagacgcacttgctttctccactatccatcttgaatctgcagctccacatttgaaatctccacttagggagcaagtgacacatgcccttgagcaatgtttgcacaagggtgttcctagagtcgagacccgattcttcatctcatcaatctatgacaaggaacaatcgaagaataatgtgttacttcgatttgccaaattggatttcaacttgctccagatgttgcacaaacaagaacttgctcaagtatcaaggtgcgatatataaaaacgatgaaccctttttgattcatcatatctcaagtactcatgttaatttcttatgctgcaggtggtggaaagatttggattttgtaacaacacttccatatgctagagatcgagtagttgaatgctacttttgggcattaggagtttattttgagcctcaatactctcaagctcgcgtcatgctcgttaagaccatatcaatgatttcgattgtcgatgacacctttgatgcttacggtacagttaaagaacttgaggcatacacagatgccatacaaaggtatgaacttcatcaattcacttattccttgatagtgaatgtcgtcgtgaaaagattaagacgaatttctactcattatagttgtgctctttcaaaatgcatgaattcaccttaattttgtcatcctgcagatgggatatcaacgaaattgatcggcttcctgattacatgaaaatcagttataaagctattctagatctctacaaggattatgaaaaggaattgtctagtgccggaagatctcatattgtctgccatgcaatagaaagagtatgttcgagcaacttaactatcgaaatacattttttccttaatccatttctcactttggtttaccttgtgttcgtcttttagtgattagaaacttgatacagttcaatcaatattttctaacacttgaacacatatatgttttgtattcacagatgaaagaagtagtaagaaattataatgtcgagtcaacatggtttattgaaggatatatgccacctgtttctgaatacctaagcaatgcactagcaactaccacatattactacctcgcgacaacatcgtatttgggcatgaagtctgccacggagcaagattttgagtggttgtcaaagaatccaaaaattcttgaagctagtgtaattatatgtcgagttatcgatgacacagccacgtacgaggtatgatttgcatctcaagaaattatatcattatatgggatttggacaaacaaagtgttgcgacgacaattaaggcaatataaaagctaacctttaatttatctgctttctaggttgagaaaagcaggggacaaattgcaactggaattgagtgctgcatgagagattatggtatatcaacaaaagaggcaatggctaaatttcaaaatatggctgagacagcatggaaagatattaatgaaggacttcttaggcccactcccgtctctacagaatttttaactcctattctcaatcttgctcgtattgttgaggttacatatatacacaatctagatggatacactcatccggagaaagtcttaaaacctcacattattaacctacttgtggactccatcaaaatttgagctgccatttgttgctcatctcaaggaaacttcattcttctttgttgtataattacgttgttagggagctgttgtgcagtgcacttcctaaactaggaccttcttaagatccttgtaatcacaatattttgttctcgatattcatacctgaatatacttgtttaacacttcaaatgatagaaattaaagttcatccgatttcacttctgtgctatcagcatatatacattttttcattccgtccattttctcctctttgtaatttcatgtatatatctaggatgtaataataactctaaacaacagttttatttgggatttttatcaagccatacactatatgaaacctttttaccctccctactcaagtttca

SEQ ID NO: 620 - DNA, 1641 bp, Ocimum basilicum
  germacrene D synthase
atgactaatatgtttgcatcggcggctccaatttcaacaaacaatactaccgtggaggatatgcgtcgatcagtcacctatcatcccagtgtttggaaagatcattttcttgattacgcttcaggcattacggaagttgagatggaacaacttcaaaagcaaaaggaaaggattaagacgttgctagctcagactctggacgattttgtgctcaagattgaactaattgatgcaatccaacgacttggggttggctatcattttgaaaaagaaatcaaccactccttacgacaaatttacgacacttttcaaataagtagcaaagacaatgatattcgtgttgttgctcttcgttttcgtctgctaagacaacatggataccctgttccaagtgatgtattcaagaaatttatagacaaccaaggaagattggatgagtcagtgatgaacaatgttgaaggaatgttaagcttgtacgaggcatcgaattatggaatggagggagaggatattttggacaaagcattagaaatttctacgtctcatcttgagcctctagcttctcgttcaagaagaattaatgaagcactggagatgccaattagcaaaactttggttaggttgggtgccagaaagttcatatccatctatgaagaagacgagtcacgtgatgaagatttattaaagtttgccaaattggacttcaatatattacaaaagattcatcaagaagagctaacccatattgcaaggtggtggaaggaactagacttgggaaacaaactaccatttgcaagggatagagtcgtggaatgctatttttggattttgggagtctactttgaaccacaatacaacattgcaagaagatttatgactaaagttatagctatgacttccatcattgatgatatttatgatgttcatggaactttggaagaactccagcgtttcactgatgctatccgaagttgggatatcagagctattgatgaattgcccccctacatgagactatgttatgaagctcttttaggtatgtatgctgaaatggaaaatgaaatggtaaagcaaaatcaatcataccgcattgaatatgcaagacaagagatgataaaattggtaacgacatatatggaagaggcaaagtggtgctatagcaagtatattccaaacatggatgagtatatgaagttggctctcgtatccggcgcttatatgatgttggcaaccacttctttagttggaatattgggggatccaattacaaaacaagattttgattggattactaacgagccaccaattttgcgagcagcatccgttatttgtagattgatggacgacgtcgtaggccatgggatagagcaaaaaatatcaagcgtggattgttacatgaaagagaatgggtgttccaagatggaggcggttggtgaattttcaaagcgggtgaagaaagcgtggaagaatttaaatgaagaatgggttgagccaagagcagcgagtatggtgattcttgtgcgtgtggtaaatcttgctcgtgtaataaatctattgtacgtgggtgaagattcatatgggaattccagcgttaaaaccaaggagttgattaaaggtgtgctcgtacaccccataaagtga

SEQ ID NO: 621 - DNA, 1626 bp, Ocimum basilicum
  alpha-zingiberene synthase
atggagtcaagaaggtcagcaaactatcaagccagcatttgggatgacaacttcattcagtccctcgctagcccgtacgcgggagaaaagtacgcggagaaggccgagaagctgaaaactgaagtgaagacgatgatcgatcaaaccagagatgaattaaagcaacttgagctgattgacaatctgcaaaggcttggtatttgccaccattttcaagatcttacaaagaaaatcttgcaaaaaatttatggggaagaaagaaatggtgatcatcaacattacaaagaaaagggcttacacttcaccgctctcagattcaggattctcagacaagatggatatcatgttcctcaagatgtttttagtagcttcatgaacaaggcaggagatttcgaggagagtctgagcaaagacacaaaaggactcgtatctctatacgaagcttcatacctatccatggaaggagaaaccatacttgacatggccaaagatttctcctcccaccatcttcataaaatggttgaggacgcgacggataaacgtgtagccaaccaaataatccacagtttggagatgccactacaccggcgagtgcagaaactcgaggccatatggttcatacaattctacgagtgtgggtccgatgcgaaccctactttggtggagctagctaagcttgatttcaacatggtgcaagccacgtaccaggaagagctcaaacgcttatcgaggtggtacgaagagaccggtttgcaagaaaagttgagcttcgcgcggcatcgattggcggaggcttttttgtggtcaatgggtatcataccggaggggcattttgggtatggaaggatgcatttgatgaagattggagcatatattactttactggatgatatttatgatgtttatggaacattggaagaactccaagttcttaccgagatcatagagaggtgggatatcaatttgttggaccagcttccagaatacatgcaaatttttttcctgtatatgttcaactcaaccaatgaactggcttacgagattttgcgagaccaagggatcaatgtcatctcaaatctcaaaggattgtgggtggaactaagtcaatgctatttcaaggaagcaacgtggtttcacaatggatacaccccaacaacagaagagtatctcaacgtagcatgcatttcggcatccggtcctgtcatcctcttcagtggctacttcaccaccacaaaccccataaacaagcacgagttacagagcttagagcgacacgctcattcgctatccatgattcttcgtctcgcagatgacttaggaacttcatcggatgagatgaagagaggggatgttccgaaagcgatccagtgtttcatgaacgacacagggtgctgcgaggaggaagcgaggcagcacgtgaagcgtctgatcgatgcagagtggaagaagatgaacaaggacatattgatggagaagccattcaagaatttctgcccgaccgcgatgaatcttggaagaatctccatgagtttttatgagcatggagatggctatggtggccctcattcagacaccaagaagaaaatggtgtccctcttcgtccaacccatgaatatcaccatataa

SEQ ID NO: 622 - DNA, 1653 bp, Ocimum basilicum
  beta-selinene synthase
atgagtgcaaactgtgtctctgcagctcccacttcaccaaaaaattcagatgttgaagagatccgtaaatccgcaacttatcactctagtgtttggggaaatcattttctttcatatacttcagacgttacggaaattactgcagctgagaaggaacaacttgaaaaactaaaggaaaaggtgaagaacttgctagcgcaaactccagacgaatcaacgggcaagatggaactcattgatgcaatccaacgactaggggttggttatcatttcacaacagaaatccaggagtccttacgacaaattcatgaaggacaaatcaggaatgacgacgatgatgttcgtgttgttgctcttcgttttcgtctgctcagacaaggaggctaccgagccccatgcgatgtgttcgaaaaattcatggacgacggaggaaattttaaggagtcactaaagaaggatgttgaagggatgttaagcttgtacgaggcatcctattatggaatagatggagaggaaattatggataaagcattagagttttcatcttctcatctcgagtccatgctgcacaatattagcactaaaactaataagtctcttttgaggcgattgcaagaagctttagacacaccaattagcaaggctgcgatcagattgggagccacaaaattcatatcaacgtaccgagaagatgagtcacacaatgaagacatattaaattttgcaaaattggatttcaatatattgcaaaagatgcatcaagaagaggcaaactatcttacaaggtggtgggaagatttagatcttgcaagcaagttagattttgcaagagatagaatggtggagagctacttttggagtttgggggtttatttccaaccacaataccgaacttcaagaatctatctgacaaaaatcatttctattgttgccgtcatcgatgatatttatgatgtttatggaagtttcgatgatctccgaagtttcaccgacgttattcaaagttggaaaattagtaatgctgatgaattgccaccatacatgagaatatgctttgaagctcttttaggtatttatgaggatatgggggatcgaattggggctccatatgcaatagacacgatgaaagaattggttgatacatatatgcaagaggcagaatggtgttacacagaatatgttccaactgtggatgaatatatgaaggtggcactggttacaggcggttatctgatggtggcaacaacttttttaactggaataaataatattacaaaaaaagattttgattggatcagaaatcgtccacgacttttacaagtcgctgaagttcttaccagattaatggatgacatagcaggccatgggacggaaaagaagaccacagctgtgagttgctacatgaaggaatatgaatgctcagagatggaagcttctagagagctgtcgaagcaagtgaagaaagcatggaaagatctgaacgatgaatggatggaaccaagatcttcatctgcagagataattggatgcattgtgaatatgtcaagggtcttgcatataatgtactccactggtgatgatggattcagtgattcttccactaggactactcaggctgttaaaactttgctcgtagatcatcccatgaactga

SEQ ID NO: 623 - DNA, 1623 bp, Ocimum basilicum
  delta-cadinene synthase
atggatgtcagtattttgagagatgtaaggccacctgtgacgagttatgcaccaaacatatgggctgatacattctccaacatttctttagatgaagaagtccagaagaaatatgcagaaacaatagaggctttgaagcaagtagttcgaggtatgttaatggctgctgcaacgcctatcaaacaaatgatattcatcgacacactcgagcgattgggattggcttatcattttgagacggagatcgaacataaactccaaaaaatatatgacgataacgtttgtggagacgactgtgatttattcacgacagcacttcgatttcgtctgctcaggcagcatcgccaccacgtttcatgcgatgtttttgacaaattcttatacgaagaaggaaagtttaaaggggatgcagaggggctattaagcttgtacgaagcatctcatgttcgttttcacaacgaaaaaatattagaagaggctgaaagatttacaaggcaagagttgagctgctggatcaagttacaatctcctcttaaagacaaagtgaaacgagctttggagcgcccccttcatcgagaagtgcccatcttatacgcgcgtcacttcatttcgatttacgagaaggacgagtccatggatgaacaccttctcaaactagcaaaattcaacttcaatttcttgcagaatttgtataagaaagagctctatgatctatcaaggtggtggaacaaatttgatctcaaaacaaaattgccatacataagagatcgactggcggaggcttatctctggggtgtaggctaccatttcgaaccacaatactcttacgttcgaaagggagttgtgttaagcataaaaattattggaattttggatgatacatatgataattatgccactgtcaatgaagctcaactttttactgaaatcctagatcgatggagcatggatgagattgatcgacttcctgattacatgaaaattgttcttcattttgttatgagcgcgtacgaagaatatgagcgcgatgcaaagatagtatatgggaaaaagtttgcatctccttatttcaaagaaacgattcaacaacttgcaaggggttataaccaagagctaaaatgggttatggaaaaacagatgcctccattcaaagactatctgaagaattcggagataacaagttgcatttatatcatgtttgcatctatcataccaggcttgaaatcctttacacaagaagccattgattggatcaagaatgagccaaacttcgcggtaaaagctggtttgatcggtcgctactgggatgacattggctcccacaagcgtgagagcaagggaggagaaatgctcaccgtgatggactgctacatgaaacaatacagtgtgtcgatacaagagacgatatctgagtttgccaaagcagtggaggattcgtggaaggaagtgaacgagggatgggtttatacgatatccatgtccaaagagatcactgtgcagtttctaaactattctcgaatgtgcgatgcgagttacaaccgaaacaatggagacggttatacggatccaagttttgccaaatcaaatattactgctctatttgttgatcctataatcatttga

SEQ ID NO: 624 - DNA, 1731 bp, Oryza sativa
  (E)-beta-caryophyllene synthase
atggcaacctctgttccgagtgtactactactacctgtgcctacctgcaccgatatgctagtctcaccagtagaaggaggagatctgctgcactgtaaaccccactttgatcaccatcctaatgtctggggcgattactttcttaccttctcaccctgcactccatcaatgcttctgaatatgaagagaaaagctcatgtttccgaggaacaagtgagaaggatgatacttgagtgttcttctggccccaatttgcacgtaaaacttgagctcgtcgacaccttagaacgtctttgcattgactaccactacgagaaggagattgaaaatgtgttgcgccgggttcatgaggaagaagacgataccgacaatcactatgacctccacactacagctctccggttctatctgctcaggaagcatggatactatgcctctccagatgtgttccagaggttcagggacgaggaaggaaatttcacacgcgatgataacaataacggcacaagaagcatgctgagcttgtacaatgctgcccatctcaggattcatggggaggagatactcgacgatgctatcgtcttcactaggaactatttgcagtctgtggtaaaacatctgcagtcgccaatggcggacgaggtgtgcagtgcacttaggacccctcttttcaggaggccaagaagagttgaagcaaggcactacatctcagtttacgacaagttgcccacacgaaatgagaccattttggagttcgccaagctcgactttgggattttgcaatctctgtattgcgaggagctcaatatcctcaccatgtggtggaaagagctccaactccaggatcatctaagctttgcgcgagataggatggtggagatgcacttttggatgcttggagttctcttcgagcctcagtactcatatgggagaaccatgctcactaaattgttcatctttgtctcgattttcgatgacatctacgacaactacagcaccttggaagaaagcaagctgttcacagaagcaattgaaagatgggatgaggaagccgctgaagaacttccaggctacatgaagttcttctacaagaaagtactgaccaccatgaaatccatagaaactgatcttaaactccaagggaacaagcatgtcgactatgtcaaaaacctattaatcgacgctacgagatgcttttacaacgaggtgaaatggcgctctgaaggtgcagatcaggtagctgctacggtggaggagcacctcaagatttcagtgccaagcagctgctgcatgcacgtccctgtctacgccttcgtcgccatgggaaacgatgtcacaaccgatgatgctatcaactggggcatggcctaccccaagatcatcacatcttcctgcatcgttggccgattactcaatgacatagcttcacatgagagagagcaagggtcttcgtcgtcgtcgtcgtcgacggtggaagcctgcatgagggagcacggcggcatcacgaaggaggaagcctacgcgaagctgagggagctcgtggaggagtcatggatggacatcgccggggagtgtctccggccggcggcggctcagccgccgccgctgctggaggccgtcgtcaacgccacacgcgtgctggatttcgtctacaaggacgaccaagatgcatacactcatccaagttcgctcaaggatacaatacactccatctacatcctctctgtttaa

SEQ ID NO: 625 - DNA, 1731 bp, Oryza sativa; identical to SEQ ID NO: 624
  (E)-beta-caryophyllene synthase

SEQ ID NO: 626 - DNA, 1623 bp, Oryza sativa
  (E,E)-farnesol synthase
atggcgccggctttccaccctgcgatattcggtgacttcttcatcaacaacgtccaaccatcacccaaagagtcagatgaatggatggaagagagagtagatcagttggttgaggaggtaggtagaatgcttgaggtttgcaaggatgatgtggtaaagcaaatgaacctggtggatgtgctccaacgtttgggaatagatcatcattttgaggagcagatcgacaccattctaaaaaatattcatagagctgagttcaatagctctgacctttacgaggttgcccttcggtttcgcttacttaggaaacaagggtattgggtctcgccagatgaattcaacaaattcaaagctgaagatgggagctttagtagtgatgacataactaatgatccgaagggcttgttaagtttatacaacgcagctcaccttctaactcacaacgagaaagcacttgaagaagctatattgtttgcaaggcatcacctacaattattgagaggcaacctcgcgtacccattggatgaacaagtaacacgtgcccttgagataccgttaccaaggaccatgaagagagtagaggtgctaaattatatcttcgagtatagcgctgaagagaaaatgttcaatccctctattttggagctagccgtgcttgatttcaatattctacaaaaagttcaccaaaatgaactcaaggaaatttgtcagtggtgggagaatctttcaagtgacattagactcgactacgtccgtgaacgtgtggttgagtgctatttttgtgcatacgctgcctactatgaaaaagagcacgcacgggcccgtatgatattcgccaagaggtgtatgctattttcactgctcgatgatacatacgatgtgcgtgcaactttagaggaggctcgcaagtttaacgatgctctgcaaagatgggacaagagtgacgtttcacttctaccagaggacctgaagagattttttctgagcataataagtaactttagggagtttgaggatgaattggaaccacatgagaaatatcgtaattcttacaacattaaagcgtttcaaatactatcgagcaatttcctccaagaagcagaatggtttcatcaaaactatattccatgctttactgatcatgtgactgtttccctccagaccggaggtgcaatagagttacctgttagtttaattgttggcatgggtgatatagcaactaaggaggtgttggattgggccttggctaaccctgatgctggtagggcctttgcagaggtggcacgattcatggatgacttagctgcatcacacagtgggagggacaagatggatgtggcgagcactgtggagtgttacatgaacgagcacggggtgacgagagaggtcgccgaggcgaagatcgctggaatggctgaggacgggtggaaaagcatgaaccagatacgcttcaagcaccgcgcgttcctcccgttcgtgcagcggatcgccaacctgtgcatgtccgccaccctcctataccatggcaagaagaatggcttcagcaatagcctggagctaaaggatatgttcgagagccattttgttaacccaatcccgcttaatcatatagattacgattaa

SEQ ID NO: 627 - DNA, 1641 bp, Oryza sativa
  alpha-zingiberene synthase
atgtcatcgacacctgcagctaatttctccaatgaagacgatgagcgaaaggctcctaccggcttccaccccagcctctggggcgatttcttcatcagttaccagccacctactgcacctaagcatgcttacatgaaagaaagggctgaagtgctaaaagaagaagttagaaaggtagtaaagggctcaaatgaagtaccagagatattggatcttgtgatcacgctgcaacgacttggattggatagttactacaaggccgagatagatgagcttctctgcactgtttacaacaccgactacaacgataaagatttacacctagtttctcttcgattttaccttctacggaagaacggctatgatgtgtcatctgacatatttcaacattttaaagacaaagaggggagttttgttgctgatgacacaagaagtcttttaagcttatataatgcggcatatatgaggactcatggtgaaaaagtacttgatgaagcagttgttttcactactaaccgcctaagatcagaattgaaacatttgaaatctccggtagccgatgaagtgtctcttgctcttgatacaccactattccggagggttagaataatagaaacacaaaactatattcctatttatgaaagcgcgactacacgaaatgaagccatattagaatttgcaaagttgaatgtcaatctccttcaacttatttattgtgaggagttaaaaactatcacacgatggtggaaagagcttaacgttgaatccaacttaagcttcattcgggatagaatagtggaaatgcatttttggatgacaggagcatgctcggagccccattattctcttttacgaattatacttacaaagatgacagcatttatcaccattctagatgatatatttgatacatatgctacaaccgaggagagcatgatgcttgccaaagcgatatatatgtgcaatgaatctgcaacagttctacttccaaaatacatgaaggatttctacttatattatttaaagacatttgattcatttgaagaggcactaggtccaaacaaaagttatcgagtgctttatttcaaagagctgttcaagatattaattaaaggatactctgaagagataaaatggcgtgatgatcattacattccaaaaacaatagaggaacacctggaactttccagaatgactgttggtgcctttcaactagcatgtgcttctttagttgggatgggtgattttataacagaggatactctcgattatcttttgacttatccaaaacttattaagtcttacacaacatgtgtacggctctcaaatgatattgcttcaacaaagcgtgaacaagcaggggaccactatgcttccacaattcagtgttacatgctgcagcatggtacaacaatacatgaagcatgcattgggataaaggagttgatagaagattcgtggaaggatatgatgaaagaataccttgcaccaacaaaccttcagccaaaaatcgtggcaagaacagttattgattttgcacgaactggggattatatatacaagcaagcagattcattcaccttttcacatacaatcaaggatatgatagcatcactttacgttgagccatatagcatttaa

SEQ ID NO: 628 - DNA, 1947 bp, Perilla frutescens
  sesquiterpene synthase
acaccatcaccttctgctctcagctctttgtaagaatcagcagatctaattaattagcatacaaaatggcttcagaacaagcacaaaatcatcggcctgtcgccgatttctcccccagcttgtggggagatcagttcatcaaacatgattcttgtccacaggttgagaagaagtattcgaacacggttgatgttttgaagaaggaagttaagggtatgataacagctcctggaaccaaaatggtcgacacgatggagctgattgacacgatcgaacgtctaggcgtgtcgtatcactttcaagatgagattgaacataaattgcagcagttttttgatctgaaaccagattattgcaacgatgatgatgacgcctatgatttgcacactgttgctcttcatttccgactattcaggcaacatggctatcgtatatcttgcgacatttttggcagatgggtccatggggatgggaaattcgaggagatactgaagagtgatgggaagggtttgctaagtctgtacgaggcgtcgtatctgagaacacgtggcgaaaccatactcgacgaggcgcttgactttgctacggccagtctgaagtcgatagcgccatgcctcgaatcaccccttgggaaacaagttgtgcacgccctagtgcagcccttgcactttggcactccaagaatcgaagcgcgtaatttcatctccatctatgaggaatatgaaggcaggaatgaatctctcttgatgtttgctaaaatagactataatctattgcaaatgctacataaggaggagcttcatcaagtctcgaggtggtggaaagagttggacctgatcgcgaaacttccatatgcacgagatagagtggtggagtgtttcttttgggcaattggagcataccatgagccgcaatattctcgtgctcgtgtaatgctcactaaaaccatcgccatgacctctataatagatgacacttatgatgcttatggtaccattaaagaacttgatatttttactgaagcaatagagaggtggaatgttaaagagactaaaaggctccccgagtatatgaaaccattatataaagctcttttggaactctaccagcaatttgaacaagaactagaaaatgaaggaagatcctacgtggcatactatgccatcgaatctcttaaggaattggtgaggagctatcgtgttgaggcaaagtggtttatacaaggatatttaccaccttttgaagaatacctaaagaatgcactcatcacctgctcttactgttaccacacaatgacgtcatttttgggggttgaatcagccattaaagaagattttgaatggctaagcaacaaacctaaaatgcttgtagctggccttctaatatgtcgactcgttgatgacatagctacttatgaggtcgagaaggctaggggtcaggttgctactggcatcgagtcctacatgaaggataatggcgcaacaaaagaagaagccatggcgaaatttttcgaaatagctagggatgcatggaaggatataaatgaggagtgcttgaggccaaacctttataactcgagggatgtttggatgcgaatcttgaaccttgaacgtataatacacgttgcttacaaagacagccaagatggatacactcaaccagaaaaggttttgaagcctcacatcattgctttgttcgtcgatcccattcaaatttagacattttatttcatggtctactgaataagcccctcttctctctttagttcgatctctctccttgtttgttccgatggtgttatgtatttccattacattagaggattgaataatacctacattgtatccttttctactttggtttatttttatgtggtccgatttcatcttttgcattatgatgtcatatgtaaaatttcacttcatcaatatatgtagttgtactgta

SEQ ID NO: 629 - DNA, 1653 bp, Perilla frutescens
  valencene synthase
atggcttcagaacaagcacaaaatcatcgccccgtcgccgatttctcccccagcttgtggggcgatcagttcgtcaaatatgattcttgtccacaggttcagaagaagtattcgaacacggttgatgttttgaagaaggaagttaagggtatgataactgctcctggaaccaaaatggtcgacacgatggagctgattgacacgatcgaacgtctaggcgtgtcgtttcactttcaagatgagattgaacaaaaattgcagcagttttttgatctcaaaacagattattgcaacgatggtgatgacgcctatgatttgtacactgttgctcttcatttccgattattcaggcaacatggctaccgtatatcttgtgacatttttggtagatggatcgatgggaatgggaaattcaaggagggactgaagagtgatgggaagagtttgctaagtctgtacgaggcgtcgtatctgagaacacgtggcgaaaccatactcgacgaggcgctcgactttgctgcggctagtctgaagtcgatagcgccacacctccaatcaccccttgggaaacaagttgtgcacgccctagtgcagcctttgcactttggcaatccaagaatcgaagcgcgtaatttcatctccatctatgaggaatatgaaggcatgaatgaagctctcttgaggttagctaaattagactataatctattgcaaatgctacataaggaggaacttcatcaagtctcgaggtggtggaaagatttggatctgatcacgaaacttccatatgcaagagatagagtggtggagtgtttcttttgggcagtcggagtataccatgagccacaatattctcgtgctcgtgtaatgcttactaaaaccatcgttatgacctctataatagatgatacttatgatgcttatggtaccattgaagaacttgatattttcactgaagcaatagagaggtggaatgttgaagagactaaaaggctccccgagtacatgaaaccattgtataaagctcttctggaactctacaagcagtttgaacaagaactagaaaaggaaggaagatcctacgtggcatactatgccatcgaatctcttaaggaattggtgagaagctatcgcattgaggcaaagtggtttatacaaggatatttaccaccttacgaagaatacctaaagaatgcactgatcacctgcacttactgttaccacacaacgacgtcgttgttgggggttgaatcagccatcaaggaaaacttcgaatggctaagcaacaaacctaaaatgcttgtagctggcctcctaatatgtcgactcattgatgacatagctacttatatcctggagaggggtaggggtcaggttgctactggcatcgagtcctacatgaaggataatggcgcaacacaagaagaacccatagctaaaattttcgaaatagctacagatgcatggaaggatataaatgacgaatgcttgagacctagcctttacaactcgagggatgttttgatgcgaatatttaaccttgaacgtataatagacgttacttacaaaggcaaccaagatcgatacactcaaccagaaaaggttttgaagcctcacatcattgtcttcttcttcgatcccattctcatttaa

SEQ ID NO: 630 - DNA, 2716 bp, Picea abies
  (E)-alpha-bisabolene synthase
cagatcagtctgtctacaagccaagccaatcaatcaagaaatttgtttgccattacaatattgcgtataactagtattagccacttccaagaatttcaaatgactagcgtttctgttgaatcaggaacagtgtcttgtttgtccagtaacaacttgatccgaaggacggccaatcctcatcctaatatctggggttatgattttgtgcattctcttaaatcgccttacactcatgattctagttacagagaacgtgcggagacacttattagcgagattaaggtgatgcttggaggtggagaattaatgatgactccatctgcttatgacacagcatgggtagcgagggtgccctccattgatggctctgcttgcccgcaatttccccaaacagttgaatggattttgaaaaatcagttaaaagatggttcctgggggactgagtcgcactttctactgtccgaccgcctgcttgctactctttcttgtgttcttgcgctccttaaatggaaagttgcagatgtgcaagtagagcagggcattgaattcataaagagaaatctacaagcaataaaggacgaaagagatcaagacagtttggtaacagactttgagatcatctttccttccttgctaaaagaagcgcaatctctcaacctcggacttccctacgacctgccttatatacgtctgctgcagacgaaacggcaggagagattagccaatctctcaatggacaaaattcatggtggaacattgttgtcatctttggagggcatacaagatattgtcgagtgggaaacaataatggatgttcaaagccaagatggatctttcttgagctcacctgcttctactgcctgcgtcttcatgcacactggagacatgaaatgccttgacttcttgaacaacgtgctcactaagtttggcagttctgttccatgcctgtatccagtggatctgctggaacgcctcttgatcgtggataatgttgaacgccttggaatcgatagacactttgaaaaggaaatcaaggaagctctagattatgtttacaggcattggaatgatagaggaattgggtggggcagactgagtcccatagcagatcttgagaccactgctttgggatttcggctgcttaggctgcatcggtacaacgtatctccagtcgttttggacaacttcaaagatgccgatggggaattcttttgctcgaccggtcaattcaacaaagatgtagcaagcatgctgagcctttatagagcttcccagctcgcatttcccgaagaaagcattttggatgaagctaaaagcttcagtactcaatatttgagagaagcccttgagaaaagtgagactttcagctcatggaaccacagacaaagcctaagcgaagagattaaatacgcgctgaagacttcttggcatgccagtgtccccagagtggaagcaaagagatactgtcaagtgtatcgccaagattatgcacacttagcaaaaagcgtttacaagctgcccaaagtgaacaatgaaaagattttggagctggcaaagttggacttcaacattatccagtccatccaccaaaaagagatgaagaatgtcaccagctggtttagagattcggggttgcctctgttcacctttgctcgggagaggccgctggaattctacttcttaatagcgggggggacgtatgagccccagtatgccaaatgcagattcctctttacaaaagtggcgtgtttgcagactgttctggatgatatgtatgatacatatggaacccctagtgaattgaagctattcactgaggctgtgagaagatgggacctctcttttacagaaaaccttccagactatatgaaactatgttacaaaatctattatgacatagttcacgaagtggcttgggaggtagagaaggaacaagggcgtgaattggttagctttttcagaaagggatgggaggattatcttctgggttattacgaggaagctgaatggttagctgctgagtatgtgcctactttggacgagtacataaagaatgggatcacttccatcggtcaacgtatacttctgctgagtggagtgttgataatggaagggcaactcctctcgcaagaggcgttggagaaagtagattatccaggaagacgtgttctcacagagctgaattccctcatttctcggctggcggatgacacaaaaacatataaggctgagaaggctcgtggagaattggcttccagcattgaatgttacatgaaagaccatcctggatgtcaagaagaagaggctctcaatcacatctatggcattctggagccggcagtaaaggagctgacgagggagtttctgaaggcagaccatgtcccattcccgtgcaagaagatgctttttgatgagaccagagtgacaatggtgatattcaaggacggagatggctttggcatttccaaattagaagtgaaggatcacatcaaagagtgtctgatcgaaccactcccactctaaccatgactatgaatcgatgtagagacttgagaacataaatcatctcctgttgtgattgtgctaattatggaatttcgaattcatttccttttccctgctctccctatatctatatgtactgttttattgcatatttccgaaaaataaataaatcatctcctcttgtgattatgctaaaaaaaaaaaaaaaaaa

SEQ ID NO: 631 - DNA, 2028 bp, Picea abies
  (E,E)-alpha-farnesene synthase
aatctgtgacacgcagaatcgctatggatttggctgtagaaatcgctatggatttggctgtagatgatgtagaaagacgcgtaggcgattatcattccaacctgtgggacgatgatttcatacagtctctctcaacgccttatggggcatcttcgtaccgtgaacgtgctgagagacttgttggggaggtgaaggagatgttcacttcaatttcaattgaagatggagaattaacgagtgatctccttcaacgcctttggatggtcgataacgttgaacgtttggggatcagcagacatttcgaaaatgagataaaagcagccattgattatgtttacagctattggagcgataaaggcattgtacgtgggcgagatagtgctgttcctgatctcaactcaattgctttggggtttagaactcttcgactccatggatacactgtgtcttcagatgtttttaaagttttccaagaccgaaagggggagtttgcctgctctgccatcccaacggagggagacatcaaaggcgttctcaatttactccgggcctcctacattgcttttcctggggagaaagttatggaaaaggctcaaactttcgctgcaacatatctaaaagaagccctgcaaaagattcaggtctcgagtctttcgcgagagatagagtacgttctggaatatgggtggctcacaaattttccgagattggaagcgaggaattacattgacgtatttggagaggagatttgtccatactttaagaagccatgtataatggttgataaacttttagaacttgcaaaattagagttcaatctctttcactccttacaacagacggagttaaaacatgtctccagatggtggaaagattcgggtttctctcaacttacattcactaggcatcgtcacgtggaattttacacgttggcctcttgcattgctattgaacccaaacattctgcattcagattaggctttgctaaagtgtgttatcttggaatagttttggatgatatttatgacacttttggaaagatgaaggagcttgaacttttcacagcagcaattaagaggtgggatccatcaaccacagagtgccttcctgaatatatgaaaggagtatacatggccttttacaattgtgtcaatgaactggctcttcaggcggagaaaactcaaggccgagatatgctcaactatgcgcgaaaagcttgggaagctttatttgatgcgtttttggaagaagcaaagtggatctcgagtggttatctgccgacatttgaggaatatttagagaacggcaaggtgagttttgggtatcgagcagccacactgcaacccatcctcacgttggacattcctcttcctcttcacatcctgcaacaaatcgattttccgtcgaggtttaatgatttggcatcttccatccttcgcttacgaggtgacatttgcggctaccaggcagagaggagccgcggagaagaagcttcctcgatatcgtgttatatgaaagataatcctggatcaaccgaggaagatgctctcagtcatatcaacgccatgatcagtgacaacatcaatgagttaaattgggagcttctcaaacccaacagcaatgttccaatttcttccaagaaacacgcttttgacattctgagagctttctaccacctctacaaataccgagatggcttcagcattgctaaaattgaaacaaagaatctggtcatgagaacagtccttgaacctgtacctatgtaactctccccagtcctgtaactggtagtgtgttatttgtgagtgcactcccctttccggtagtgtgttatttgtgaatgtccctgtagtgggtgttaaggaaattatctaattacatccttaactagtttgttagttagtttaccgttacacgagttggtaactctgtaacttcttgtaaccatattgtgtaactatacatgttcatattaatagaatacacatcaatagtgtagtgtgttgcatcaaaaaaaaaaaaaaaaaa

SEQ ID NO: 632 - DNA, 1737 bp, Picea abies
  longifolene synthase
atggctcagatttctaaatgttcgtcactgtccgccgagttgaacgaatcctccatcatctctcatcatcatggaaatctgtgggacgacgatttcatacaatctcttaagtcgtccaatggggcacctcaatatcatgaacgcgctgcgaaacttgttgaagaaatcaagaatttagttgtgagcgagatgaaagattgcaacgatgatttaatcagacgtcttcagatggttgacatttttgaatgtctaggaattgatcggcactttcagcatgaaatacaagttgctcttgattacgtgtacagatattggaaccagctggaaggcatcggtattggatcaagagattcccttatcaaagatttcaatgctacagctttgggatttcgggctctccgactgcatcgatataacgtttcctcagatgtcttggagaatttcaagaacgaaaacgggcagttcttctgcagttccacggttgaagaaaaagaagtgagatgcatgttgacgttatttcgagcttcagaaatttcatttcccggagaaaaagtgatggacgaggcaaaggcgttcacaacagaatatctaaccaaagttttaacgggagtggatgtaacggacgtcaatcaaagccttttgagagaagtgaagtatgccctggagtttccatggcattgcagtttgccgagatgggaggcaaggagctttatcgaaatatgtggacaaaacgattcatggctcaagtcgattatgaacaaacgagttttagagttggcgaaattggacttcaatattttgcaatgggcacatcatagagaactacagcttctgtcaagttggtggtcacaatcggatatagcgcagcagaatttctatcggaagcgtcacgtggaattttacttatgggtggttataggcacgttcgagccggagttttcaacatgcagaatcacctttgcaaaaatctctacactgatgactattctagatgacctctacgatactcacggaacgttggaacaactcaaaatcttcacagagggagtgaaacgatgggatctttcgttagtagaccgccttccagactacataaagattacattcgaattcttcctcaacacatctaatgaattgattgctgaagttgcgaaaacgcaagagcgggatatgtcagcctacatacgaaaaacatgggaacgataccttgaagcttatttgcaagaagcggaatggatagcagctcgacacgtccctacgtttgatgagtacatgaagaatggcatatccagttctgggatgtgtatactaaatttgtattcgcttctgttaatggggcaacttctacctgacgacgttctggagcaaatacactctccatccaagatccacgagcttgtagaattgacggccagactggtagacgactcaaaggattttgagacgaagaaggttggtggggagttagcttcaggtatagagtgttacgtgaaagacaaccctgaatgtacactggaagatgcttcaaatcatctaaatggcctccttgatcttaccgttaaggaattgaattgggagtttgtaaggcatgacagcgtggccttgtgtttcaagaagttcgccttcaacgttgcacgaggcctccgacttatctacaaatacagagacggctttgacgtttctaaccaggagatgaaaacccacatattcaaaattctcatcgatccacttacttag

SEQ ID NO: 633 - DNA, 2084 bp, Pinus taeda
  (E,E)-alpha-farnesene synthase
ggccaagtgtgtagggcggagaaatctgtgagacacccgccatcaccatgagttctttggctgtagatgatgcagaaagacgcgtaggcgattatcatcccaacctgtgggacgatgctctcatacagtcgctctccacgccttatggggcatctccgtaccgtgatgttgctgagaaacttattggcgaaataaaggagatgttcgcttcaatttcgattgaagatggagacgacgagatatgttatttccttcaacgcctttggatgatcgataacgttgagcgtttggggattagcagacatttcgaaaatgaaatcaaagcagccatggaagatgtttacagccgtcattggagtgataaaggcattgcatgtgggcgacatagtgttgttgctgatctcaactcaactgctttggcatttagaactctacgattacatggatacagcgtgtgttcagatgtttttaagattttccaagaccaaaagggggagtttgcctgctctgccgatcagacagagggagagatcaaaggcattctcaatttactgcgggcctcgctaattgcctttcctggggagagaattctgcaagaggctgaaatcttcgctacaacatatttaaaagaagccctgccaaaaattcagggctcccgtctttcgcaagagatagagtacgttctggaatatgggtggctcacagatttaccgagactggaaaccaggaattacattgaagtattagcagaggagattactccatattttaagaagccatgtatggcggttgaaaagctgttaaaacttgcaaaaatagagttcaatctctttcactccttacaacaaacagagttaaaacatctgtccagatggtggaaagattcaggtttcgctcaacttacattcactaggcatcgtcatgtggaattttacacgttggcctcttgcattgctatggaacccaaacattctgcattcagactgggctttgctaaactgtgctatcttggaatagttttggatgatatttatgacacttacggaaagatggaggagctggaacttttcacagcagcaattaagagatgggatacatcgaccacagagtgccttcctgaatatatgaaaggagtatacatggcattttacgattgtgttaatgaaatggctcgacaggcggaaaaaactcaaggctgggatacgctggactatgcgcgaaaaacttgggaagctttaatcgatgcgtttatggaagaagcaaagtggatctccagtggttatgtgcccacatttcagaaatatttagacaacgggaaggtgagttttgggtatcgagcagccactctccaacccatcctcacgctggacattcctcttcctctacacatcctgcaagaaatcgattttccatccagctttaatgatttggcatcttccattcttcgcttgcgaggtgacatttgcggctaccaggccgagagaagtcgtggggaacaagcttcttcgatatcctgttatatgaaagataatccgggatcaactgaggaagatgctctgagccatgtcaacgccatgatcggtgacaagatccctgagtttaattgggagtttatgaaacccagcaaggctccaatttcttccaagaaatacgcttttgacattctcagagctttctaccacctctacaaataccgagatggcttcagcattgccaaaattgaaacaaagaaattggtgatgagaactgtccttgaccctgtaccaatgtaagtctatcaataaagtctgagtcctttcgagaactgtccttgaccctgtaccatgttaagtcctatccaaaaagtctgagtcctattgagtacaggcaatacatatggaacatggaagcctaaggaagcttaataacattataagagtaaatgttcttttaacttttatgagaagtctttttagactcaagtaattaccccatttcatcatggaacttatcagtgtttcgttagtgtatttttaaaaggttgattttcaatttttatgaaaataggttgatatttctgatactaaaaaaaaaaaaaaaaaaaa

SEQ ID NO: 634 - DNA, 2602 bp, Pisum sativum
  ent-kaurene synthase A
atcacacatcactctaaaactaaacattacttacttctttccatcatcaccatgtttactcacttctccacccactttcatcttccatcttcttcttctctcttctttcttcatccattctacaaatcctcttctttaggtgctgtgtcgtttgtggctaaagacaaagagaaaagatgtagagctatatccaaatcaagaactcaggaatatgaaggagtatttcaaactaatgtagcaacattaaagttgagtgaaattaatgtggaagatgtcatagtcatagatgatgaagaggagcaagatattagggtgggtttagtgaacaaaataaaatcaatattgagttcattggaagatggagagataactatatctgcttatgatactgcttgggttgctcttgttgaagatgttaatgctattagcacccctcaatttccttctagtctagagtggattgcaaaaaatcaacttcaagatggttcatggggtgatagccgattattctcggctcatgatcgaattatcaatacattggcatgtgtaatcgcgttacgatcatggaatatgcattcagaaaagtgtgacaaaggaatgatattttttagagagaatcttagcaagcttgagaatgagaatgaggagcatatgccaattgggtttgaagttgctttcccttcactacttgaaggagctagagggattaaaccattgatgtgcccaaatgattctccaatattgaaaaacatatttgaaaagagagatgaaaaactcacaagaataccaaaagagataatgcataaagtgccaacaacattgttgcatagcttggagggtatgtctggcttggattggaaacaacttctaaaattgcaatcacaagatggatcattcttgttttctccatcttccacagcttttgcattaatgcaaactaaagatggaaattgcctaaaatacttgaataatgttgtcaaaaaattcaatggaggagtcccaaatgtgtatccggtggatttatttgaacatatttgggtggttgatcgtctcgaacgccttggaatatctcgattttttcgacatgagatcaaagattgtatgaattatgtgtctaagatatggagtgaaaaaggaatttgttgggcaagaaattcaaatgttcaagatattgatgacacagcaatggctttcagattacttagattacatggtcaccaagtttcagcccatgtgtttaagcactttgagagaaatggtgaattcttctgctttgctggtcaatgcacacaagcagtgacaggaatgtataatctatttagagccagtcaagtgctttttccaggagagaaaattcttgaacatgccaaacacttttctgccaaagttttgaaggaaaagagagaagcaaatgaactcatagataagtggatcataatgaagaatctgcctgaagaggttggttatgcattggacatgccatggtatgcaaatttagatcgcattgagacaagattttacattgatcaatatggtgctgaaagcgatgtatggattggcaaaactctttacaggatggcgtatgtgaacaacaacaattatctcgagcttgctaaattagactacaacaattgtcaagcacaacatttaatcgaatggaatgtaattcaaacatggtacttagaatctagattgggcgaatttggattgagcaaaagggatcttttattggcttattttttggccaccgggagcatatttgagcctgaaagatctcatgagagacttgcttgggcaaaaactacggctctccttgagacaatcaagtgttatgttaggaatgaagatttgaggaaagattttgcgaaaaaattcaatgaccacatcgatgttcgagactattctattgcccggaggatgaagaggaacaaaacagaacatgaacttgttgagagtctgtttgcaaccataggtgaaatatcatgggatgtaagattgtcttatggtcatgaaattggatatgatatgcatcaatgttggaaaaagtggctttcaagttggcaaagtgaaggagacaaatgtgaaggagaagcagaacttttgatacaaataataaacctatgttctaaccattggatttctgagggaccaagtatgcaatccacaatacagcatcttcttcaactcactaactctatatgccataaacttagttgctatcaaaaggacaaggaattaaaaggcatcagctgccaggaaaacatcaccaactcagaagtagagtccaaaatgcaagaacttgtacaaatggtgtttcaaaaatgtcctaatgacattgattttaatgtcaagaatactttcttcacaattgcaaagtccttttactatgcagctttctgtgattcaaggaccatcaactttcatattgcaaaagttctctttgaaaaagttgtttaatcaaatttattgatttgtataggtattagttcactttcattcatgtgaatatatattttccctttaatgtaatattgaaacaaaaaggaaaatatttgttattgtgattcaatgtgtatatattgtcgttttctaataaatttca

SEQ ID NO: 635 - DNA, 1638 bp, Pogostemon cablin
  (-)-germacrene D synthase
atggatttgaatgaaatcacctcttcatctcgtcctctcgcaaattatcacccaaatgtgtggggagaccgtttccttctgcatgaaccagaattcacttgccaggctggtgagaaacaactagttgaagagctgaaagaggaagtgagaagggagctgaaggaagcgtcgaacgactaccttcgacagctgaagatggtggacgcaatacaacgactaggcatcgagtatctctttgaggaagagattgatgaagctctgagaaatctgttggcaaaattcgagaattattgcaaggataatcatgatatgtacgccactgctcttagctttcgccttctcagacaacacggatacaaggtttcatgtgaagtttttgacaagtttaaggatggggaagatggattcaaggtggaagaagtgatggcagttctcgagttgtttgaggctacacatatgagaattcatggagaagatgtgctcgatcaagcctttgttttcacaaggaattaccttcaatcaattcacgcaaccttgagtaatccaattgctaaacaagttcacaacgcattgaatggatactcttgtcggagaggaatgccacgaatcgaagcgaggaagtatatacccatctacgaggaatacggttgtcaccataaagccttgctcaaacttgctaagctcgatttcaatctacttcaatctatgcacaaaagggagttgactcaactttataggtggtggaaagatttggaaatgccaacaaagctaccgtacataagagatcgattggtggagacatacttttgggacatggggttttattttgaaccacaatatgctctagctagaaatatcttagtcaaagtacaatgtttggtgtctattttcgatgacacttttgatgcatatggtgcttttaaggaattacaactcttcaaagatgccattgatagatggagtatctcatgcttagatgaacttccagagtatatgcagataatctacaaactggttttggacgtgtttgaagaaattgagagtcatatgatcaaacaaggaacatcgtatcgtctggactatgcaagagaagcgataaaaattgtgattggaggttactttgatgaggcaaaatggagggaagaagagtacaagccaagaatggaagagtacatgaaagtagctacaaagagtgcagcctacttaactctaatcatagtatcatttgtagggatgaaaaatgacattgccaccccacaagccttccaatgggtcctttctgaacctcaaattattacagcttctttagctcttgccaggctctccaatgatctcgtgggcattgagtttgagaaagagagaaagtatatagcgacagcagtggagttgtacgaggaagagcataaagtgtcaaaagaagaggctgtgttggaattgaggcatgaaacagagtcggcatggaaggaaattaatgaggcgttgttagagccaactacatttgcgaccccaattcttgatcgtatacttaattccgcccgagtacttgaagttttttacgacaagaccgaccgctacacacatgtggatcttgaattgcagaatatcatcgcccaactatacattcaccctattccttaa

SEQ ID NO: 636 - DNA, 1665 bp, Pogostemon cablin
  (-)-germacrene A synthase
atggaattgaaaaaccaaagtgttgcaataatctccagcaatgcttctcgcccacttgcgcattatcatccagacgtatggggagatcgtttccttctctacaaaccaaatcccagttctgaggctggtcagaaaccagttattgaagagctgaaacagcaagtgagaagcgagctgaaggaagcatcgaacgactacatgcgacagctgaagatggtggacgcaatacaacgacttggcatcgagagtctctttgaggaagacattgataatgcattgaagaatctgtctgaaaattttgatgattactgcaaagataagcatgatttgtatgccattgctcttagctttcgccttctcagacaacatggatacaggatttcatgtgatgtattcgacaagttgaaggatggcgaagatggattcaaagttcccccttcagatgaagcgcttgcagttgtagagttgttagaggccacgcatctaagaatccatggagaagttgtgcttgatcgtgcctttgttttcgccaggattcaccttgaatcgattgaagcaaatttgaataatccagtcgcgaaacaagttcataacgcgttgtatggatactctaatcggagaggaatgcaacaagtagaagcgaggaagtacatacccatctacgagcaatatgcttctcatcatcaaggcttgctcaaacttgctacgctgaattttaacctgcaacaaaccatgcacaaaagggagttgagtgaactttcaaggtggtatagagatttagaagttccaacaatgttaccatttgctagacaacgattggtggagacatacttctgggacgctggagtagtttttgaaccagaaaatgatgttgccaggatgattttagtcaaagtgcaatgcctaatctcttttcttgatgatacttttgatgcatatggaagttttgaggaactacaactcttcacggatgcaattaatacatgggatgtttcatgtttagatcaacttccagattatatgaagataatttacaaagcccttttgggagtgtttgaagtaattgagaaactaatgatcaaacaaggaacattgtatcgtctcaactatgcaaaagaagcgatgaaaatagtggtgggaggttactttgttgaggctaaatggagggaagaaaagagcaaacccacgacgcaagagtacatgcaggtagcaacaaagagtgcaggatatatgactcttattataacatcatttcttggaatggaagcaaatattgccaccaaagaagccttcgattgggtgctttctgagcctgatgttatgaaagctgcaataactcttgccaggctcaccaatgatatcgtcggaattgagctcgagaaagaaagaaagcatatagctacagcagtggaagtgtacgaggacgagcataaattgtccatgcaagaggccatggttgaaatcaagaatcaaatcgagtcgggatggaagaccataaatgaggcgtttcttagaccaactaaatttccaacacctatactttatcgtatactcaattactgcagagttcttgaggttatttacgacaagagcgatcgctacacacatgtggatcctgcattgcaagacatcatcaagcaactatatattcaccctattccatag

SEQ ID NO: 637 - DNA, 1665 bp, Pogostemon cablin
  (+)- germacrene A synthase
atggctgtacaaatctccgaaactgttcgccctttcgccaatttttctcccaatcccagcttgtggggtgatcaattcatcaaccacaaatctaaaactcagcaaatatcgaggatatatttggaggaaattgaagggttgaaaaatgaagtaaagtgtatgctaacaagtaccccagagggaaagatggcggacaccgtcaacctgatcgacacactcgagcgcctaggggtatcgtatcatttcgaaaaggaaatcgaagagaagatgaaacacttattcaatctgatcaaagcggataactataaagatcatgaaggctgtgatttgtatactgatgctcttcattttcgattattcaggcagcatggttaccctatatcttctgggatttttaacaaatggatggatgggaatggaaaattcaaggagagcattaagagtgatgcaaagggtttgttgagcttgtatgaagcatgctgtttgagaacacatggagacaccctactcgacgaagcccttgtttttgctacggccagtctgaaatccatggcagcaaaccttgcgtcacccctaaggaaacaggttgagcatgccctcttccagcacttgcattttggcattccaagagtcgaagcacgacacttcatcaccttctacgaagaggaagagcacaagaatgagatgctgcttaggttcgccaaattggactttaatgcattgcaagcactgcacaaagaggagctgagtgaaatcagcaagtggtggaaagatttggatctcatctcgaaacttccatatgcaagagacagggtggtagagtcttacttttgggcagtgggagtgtactatcaacccaagtactctcgtgcccgtattatgctcactaaaaccattgccatgacggctatattggatgacacctatgactcttatggtacacttgaagaacttgatgttctcacaaaggcaattgagaggtgggatatcaaagaaattaatggactcccagagtacatcaaaggattctataaacaggtgctgaaactctatcagcaattagaggaagaattagcaaaggaaggaagatcttatgctgtatactatgcaatagaagcttgtaaggaattggcgaggagctacgctgtggaggcgaagtggttcaagaaagggtacttgcccggatttgaggagtacctaatcaattctctcgtcacctccacggctggctatctcaatataatctcgttttttggcgtggaatctgtaaccaaggaagattttgaatggtttagcaagaagcctagaatcgctgtagccactcagataattacaagagttatcgatgacattgcaacttatgaggtagagaaggagaagggtcagagtgccacaggaatagattgctacatgaaggaacatggggtgagcaaagagaaggcaatgcagagattctatgaaatgagtaccaatgcatggaaggatattaatgaggaaggcctcagttggccatcttctttttccagggatattttcgtccaactccgaaattttagtcgcatggttgatgttacctatggcaaaaatgaagatggatactccaaacccgaaaagattctcaagccacttatcattgctctgtttgttgatcagatcaagctttaa

SEQ ID NO: 638 - DNA, 1659 bp, Pogostemon cablin
  patchoulol synthase
atggagttgtatgcccaaagtgttggagtgggtgctgcttctcgtcctcttgcgaattttcatccatgtgtgtggggagacaaattcattgtctacaacccacaatcatgccaggctggagagagagaagaggctgaggagctgaaagtggagctgaaaagagagctgaaggaagcatcagacaactacatgcggcaactgaaaatggtggatgcaatacaacgattaggcattgactatctttttgtggaagatgttgatgaagctttgaagaatctgtttgaaatgtttgatgctttctgcaagaataatcatgacatgcacgccactgctctcagctttcgccttctcagacaacatggatacagagtttcatgtgaagtttttgaaaagtttaaggatggcaaagatggatttaaggttccaaatgaggatggagcggttgcagtccttgaattcttcgaagccacgcatctcagagtccatggagaagacgtccttgataatgcttttgacttcactaggaactacttggaatcagtctatgcaactttgaacgatccaaccgcgaaacaagtccacaacgcattgaatgagttctcttttcgaagaggattgccacgcgtggaagcaaggaagtacatatcaatctacgagcaatacgcatctcatcacaaaggcttgctcaaacttgctaagctggatttcaacttggtacaagctttgcacagaagggagctgagtgaagattctaggtggtggaagactttacaagtgcccacaaagctatcattcgttagagatcgattggtggagtcctacttctgggcttcgggatcttatttcgaaccgaattattcggtagctaggatgattttagcaaaagggctggctgtattatctcttatggatgatgtgtatgatgcatatggtacttttgaggaattacaaatgttcacagatgcaatcgaaaggtgggatgcttcatgtttagataaacttccagattacatgaaaatagtatacaaggcccttttggatgtgtttgaggaagttgacgaggagttgatcaagctaggcgcaccatatcgagcctactatggaaaagaagccatgaaatacgccgcgagagcttacatggaagaggcccaatggagggagcaaaagcacaaacccacaaccaaggagtatatgaagctggcaaccaagacatgtggctacataactctaataatattatcatgtcttggagtggaagagggcattgtgaccaaagaagccttcgattgggtgttctcccgacctcctttcatcgaggctacattaatcattgccaggctcgtcaatgatattacaggacacgagtttgagaaaaaacgagagcacgttcgcactgcagtagaatgctacatggaagagcacaaagtggggaagcaagaggtggtgtctgaattctacaaccaaatggagtcagcatggaaggacattaatgaggggttcctcagaccagttgaatttccaatccctctactttatcttattctcaattcagtccgaacacttgaggttatttacaaagagggcgattcgtatacacacgtgggtcctgcaatgcaaaacatcatcaagcagttgtaccttcaccctgttccatattaa

SEQ ID NO: 639 - DNA, 1638 bp, Pogostemon cablin
  gamma-curcumene synthase
atggctgcttttactgctaatgctgttgatatgaggcctcctgtcatcaccattcatccccgttccaaagatatcttctctcagttttccttggacgataagcttcagaagcagtacgcacaaggaattgaagctctgaaggaagaagcaagaagcatgttaatggctgcaaaatcagccaaagtcatgatactaatagacacactcgagcgtctgggattaggatatcattttgagaaggagatcgaagagaaactcgaagcaatatacaagaaggaagatggtgacgactatgatttgttcactactgcgcttagatttcgtctgctcaggcaacatcagcgccgtgttccctgcagtgtttttgataagtttatgaacaaagagggcaagtttgaggaagaacccttgattagtgatgtggagggactactgagtctgtatgatgcagcctacctgcagatccatggggaacacatcttgcaagaagccctaattttcacaacacatcatttaactcgtatcgagccacaattagacgatcactctccccttaaactcaaactgaatcgagctttggagtttcctttttatcgagagatccccatcatttatgcacacttttacatctccgtttacgagagggatgactctagagatgaagtgcttctcaaaatggcaaaattgagctacaatttcttgcaaaatttgtacaagaaagagctttctcaactctccaggtggtggaataaattagaactaataccaaacctaccatatataagagacagcgtggcgggtgcctatctttgggctgtagcattatatttcgaacctcaatattctgatgtccgaatggccattgccaaattaatacaaattgctgctgcagtagatgatacatacgataattatgcgaccattcgagaagctcaacttcttactgaagctttggagaggttgaatgtgcatgaaattgatacccttcctgattatatgaaaattgtttatcgtttcgttatgagttggtcagaagatttcgaacgagatgcaacaattaaagaacagatgcttgcaactccctacttcaaagcggagatgaaaaaacttggaagggcttacaatcaagagctgaagtgggttatggaaaggcaattgccttcatttgaagaatatatgaaaaattctgagattacgagtggtgtgtatataatgttcactgtcatttcaccatacttgaattctgctacacaaaaaaacattgattggttgctgagtcaacctcgtctcgcttcatccactgccatagttatgagatgctgcaatgacttgggcagcaatcaacgcgagagcaagggtggagaagtgatgacttccctggattgctacatgaaacaacatggtgcatcaaagcaagaaaccatatctaaatttaaactaataattgaggatgaatggaagaatttgaacgaggaatgggcagcgaccacttgtttgccaaaagtaatggtggagatatttcgcaactacgcaagaattgcaggtttctgttacaaaaacaatggagatgcttatacgagtcccaaaatagttcagcaatgttttgatgccctttttgttaaccctctacgcatttga

SEQ ID NO: 640 - DNA, 1877 bp, Populus balsamifera
  (-)-germacrene D synthase
acagtatacccttcaaaacacaaacgatcgaacctcagaaacccactaattcccaaaccatactaggaaaatgtctgttgaaggttctgcaattttctctactgccactgtcgagcccaatgttagtcgccgttcggcaggttattctcctagcatttggggtgaccattttctctcgtacgcaaccgattccatggaaacgagtgacaaagcagagcataaaaaactgaaggaagaagtgaaaagggagctgatggccaatatcaataagccttcacaaacactggacttcattgatgcgatccaacgcttaggcatctcttaccattttgagattgagattgatgaaatactaagagaaatgtacaagtcccattgcgacttcgataatggagatgatgatgatcatcatcataatgacctatacgccatttctctcaaatttcgactgcttagacaacaaggttataaaatctcatgtgatgtgttcggcaaattcaagaacagccaagggaccttcaatgattcccttgccaatgacactcgaggaattttaagcttatatgaagctacacatctccgggtgcatggagatgaggtattagaagaagcacttgtgttcactacttcccacctagagttcttggccacccattcaagctctccgctgagagcaaaaataaatcatgctttaaagcagcctgttcgcaagaacataccaaggctagaagcaaggcattatttctctatctaccaagaagatccttcatgtagtgaagttttactgaacttcgctaaattagacttcaacattttgcaaaagcaacaccagaaggaactaagtgaaattgcaaattggtggaaagaattagattttgctaagaagctgccttttgcaagagacagagttatagagtgctacttttggatactaggagtgtacttggagccagagtatttcttggctcgaaggatactgaccaaagttattgccatgacttccgtcatcgatgacatctacgatgtctatggtacaccggaagaactcgagctctttactgatgcaattgagaggtgggaaattactgccgtagatcagctgccagagtacatgaaagtgacttacaaggcacttctagatgtctacacagaaattgaggaaaatatggtcactgaagaaagatcataccgtgtctactatgcaaaagaagcaatgaagaatctagttcgagcctactaccttgaatctaaatggttccaccaaaaacacacaccaacaatggaggaatacatggctgttgcattggtcacttcgggctatgcaatgctagcagctacatcctttgttggaatgggacatgttgtaactaaggactccttcgattggttatttaggggacctaagattcttaaagcctcagaaataatttgcaggctcatggatgacatcgtgtcccacaagttcgaacaaaagagagggcatgttgcctcgagcattgaatgttacatgaaacagcatggcaccacagaacaagaaactgtccacgaatttcgaaaacaagttacagatgcttggaaggatctcaatgaagagtttctccacccaaccgctgtccccatgcctcttctgacaaggatgctcaatcttgctcgtgtgattgatgttgtgtacaaagatgaagatggctatacaaatgctggaactgtgctcaaagatcttgtttctgctctactcattgatcctgtgccaatgtgatcagctagtaattaagacttaaacctgtcatgttgctgaactaataggattaaaatcctctatcaccagtaaatactgtgatgctgattcaaccggtccaataaattttttctctgtttta

SEQ ID NO: 641 - DNA, 2528 bp, Pseudotsuga menziesii
  (E)-beta-farnesene synthase
aagccaaatttgtttgccattcccttccaaattatagctcatattttatgagcttggaagaattttatccaatggctaccgtttatgtaccttcttctactctgccttgtgctttgtcgacgagtagcagtagcagcagcttggtcagaaggacggccaatcctcatcctaatgtctgggattatcattttgtacaatctcttcaatcgccttacactgatccttgctatggagaacgtgtggagacacttgttgctgagattaaggcgatgcttcatggtgaaggaggcttaatgatcaccccatctgcttatgacacagcttgggtagccagggtgccctccattgatggctctgctcgcccgcaatttcctcaaacagttcaatggattttgaaaaaccagttaaaagatggttcttggggtactgaatcgcactttctactgtccgaccgactgcttgccactctttcttgtgttcttgcgctccttaaatggaaagttggggatctgcaagtacagcagggcattgaattcataaagagcaatctagaagcaataaaggatgaaaacgatgaagacagcttggtgacagactttgacatcatcttcccttccttgttaagagaagctcaatatctagacattgaacttcccctacaacctgccttatgtaagtctactccacccaagcggcaggagagattagcaaatatgtcaagggaggaaattcatggcgttccgtccccattgttgtattctttggagggcatagaagacatggtcgactgggaaagaataatggatgttcgaagccaggatggctctttcctaagctcacctgcttctattgcgtgcgtcttcatgcacactggagacatcaaatgccttgagttcttgaacaacgtgctcactaactttggtacttttgttccctgcttgtatcctgtggatctgctggaacgcctcttgatagtggataatcttgtacaacttggaatcgatagacactttgaaaaggaaatcaaggaagctctcgattatgttcacaggcattggaacgaaagaggaattgggtggggcagactgaatcctatagcagatcttgagatcactgctttgggatttcgactccttcggctccatcggtacaatgtatctccagcggttttcgagaacttcaaagactcaaatgggcactttgtttgctcgggtgctcaattcaacaaagatgtagcaagcatgctaagcctttatagagcttcccagttggcatttccgggagaaaatattttggatgaagctaaaagcttcactagtaaatatttaaaagaagctcttgagaaaagagagacttacagcgcgtggaacaacaaacaaagcctaagcgaagagattaaatatgctctggagaattcttggcatgccagcgtcccgagagtggaagcaaagagatattgtcaagtgtatcgctcagactatacatatctagcaaaaagcgtttacaagctgccaaaggtgaacaacgaaaagattttagagttggcaaaattggactttcaacattatccaggccatccaccaaaaagagatgaagaatgtcaccacctggttaaaaattcggagttccctctattaccgttcggtcgggagaggccggtggagtgtttcttcatagtagcggcaggcacgtatgagccccagtatgcgaaatgcagattcctgttttcaaaagtggcgtgcttgaatactgttctggacgatatgtatgacacatatggaacccttgatgaattgaagctattcaccgaggctgtgagaagatgggacctctccttgacagaaaaccttccagactatatgaagctctgctacaaaatcttctacgacatagttcacgaagtggttttggaggcagagaaggaacagggacgcgaactgcttactttttttagaaaggggtgggaggagtatctgatggggtattacgaagaagcagaatggttggcctgtgagtacctgccaagcttggaggagtacataaggaacgggatcatttccatcggacaacgaatacttgtggtaagcggtgtgttattgatggagggccaaatcctttcgcaagaggcgctggaacagttggattatccaggaagacgagtcctgacggagttgaattccatcattacccggctagcagacgacatacatacatataaggcggagaaggctcgtggagaattggcgtcgagcattgaatgttatatgagagaacatccgggaagtacggaggaagtggctgtgaattacatgtacagccttctggagccggcagtgaaggagctgacctgggagtttctgaagcccgaggacagtacagtccacatcccattccagtgcaagaagatgctgatggaagagacgagagtgacaatggtgatattcaaggaaggagatgggtttgggatctcaaaaacaaaaataaaggattacatcaaagactgtctaattgaaccactgcctctgtaa

SEQ ID NO: 642 - DNA, 2520 bp, Pseudotsuga menziesii
  (E)-gamma-bisabolene synthase
agtttgcgtagaagcagagccattcaatcaaaggatttttgtttgaaattacatttcatactcttccttcaaatggcagcttctactcttccttccggtttgtccactaacgacttgatccgaaggacggccaatcctcatcctaatgtctggggttatgatcttctatgttctcttaaatcaccttactctcgtgattctagttacaaagaacgtgcagacacacttattaatgagattaaggcgatgcttggtgctgcgtttggagatggaaaggaaatgattactccatctgcttatgacacggcatgggtagcgaggataccctccattgatggcagctctggctctgctcgccctcaatttcctcaaacagttgattggattttgaaaaaccagttgaaagatggttcttggggaactgagtcacactttttattgtcagaacccctgctggccactatttcttgtgttcttgctctctttaaatggcaagttggggatctgcaagtagaacggggcattgaattcctaaagagcagcctagaaaaaataaaaaacgaaagcgatcaagacagtttggtaacagactttgagatcatctttccttccatgttaagagaagctcagtctctccaccttggacttccgtacgacctgccttatatacagctgctgcagacgaaacggcaagagagattagccaatctctcaagggagaaaattcatggcggaatattgcagctatcatctttggagggcatagaagatatggtcgagtgggaaagattaatggatcttcaaagcctagatgggtctttcttgagctcacctgcttctaccgctttcgttttcatacacactggagacctgaaatgtctggcattcttgaacagcgtgcttgctaagtttggtgcttttgttccatgcctatatcatgtagatctgctggaacgcctgttgatagtggataatattgaacgccttggaatcgatagacactttgaaaaggaaatcaatgaagctctagattatgtttacaggtattggtcgaacgaaagaggaattgggtggggcagaatgaatgccactgcagatcttgagaccactgctttgggatttcgactgcttcgacttcatcgttatcatgtatctccagtcgttttcaagaaattcaaagatgctgatggggaattcttgagctcgatcggtcaatttaacaaagatgtagcaagcatgctgaacctttatagagcttgcgagcttgcatttcccggagaaaacattttggatgaagctaaaggcttcactgccaaatatttgagagaagctctggagaaaactgagactttcagctcgtggaacatcaaacgaaacctgagccaagagattaaatacgcactgaagacttcttggcatgccagtatccccagagtggaagcaaagagatactgtcaagtgtatcgcccagattatgcacgcttagacaaaagcgtttacaagttgcaccacgtgaacaacgaaaagattttggagctggcaaaattggacttcaacattatccagtctatcctccaagaagagatgaagaatgtcaccagctggtttagagattcggggttgcctttgttcagctttgccaggcagagaccgctggaattctacttcttgataacagccgggacgtatgaaccccggtatgccaaatgcagattactctttaccaaagtggcgtgcgtggaaactgttctggacgatatgtatgacacatatggaacccttgatgaattaaagctattcactcaggctgtcagaagatgggatccctcccttacagaaaaccttcctgattacatgaaacgttgctacaaaatcttttacgacatagttcacgaagcggcttgggaggcagaaaaggaacaggggcgtgaattggttagctttttaagaaaggcatgggaggattttgttttgagttatcacgaagaagctgaatggttaagtgctgagtatgtgcctggcttcgacgagtacataaagaatgggatcacttccattggccaacgtgtacttttgctgagtggattgttggtgatggatgggcaactcctttcgcaaaaggcgttggagaaaatagattatccagaaagatcacgtgtcctcatggagcagatatgtctcatttctcggctggcggatgacacacagtcatacaaggctgagaaggctcgtggagaattggcttccggcattgaatgttacatgaaagaccatcctgaatgtacagaggaagaggccctgaatcacatctatggcattatggaggtgacagcgaaagagttgacgaaggagtatctgaaggtagacgacgacgacgtcccattcgcgtgtaagaagatgctttttgaagagacgagagtgacgatggtgatattcaaggatggagaccggttgagcaattccaaattggaaatgaaggatcatttcaaggagtgtcttattgaaccacttcctctctaa

SEQ ID NO: 643 - DNA, 1653 bp, Ricinus communis
  (+)-delta-cadinene synthase isozyme A
atgtcggctcaaactttggcaatttcgaatttaaaacccaatactactcgtcacttggcgagttttcatccgaatatttggggagatcgctttctttcatgtgctgctgaatccacggatattgaggatgatatggagcaacaagttgagagattaaaggaggaagtgaaaaagatgattgcttctgctgatgaaccctcacaaattctcaatctgattgatcttctccaacgattaggtgtgtcttaccattttgaaaaagagattgaggaagcattgcagcaagtgttgaatatgaacagtgattctgacaaggatgatgaccttcatagtgtcgctctccgatttcgattacttagagaacaaggcctcaatgtctcttgtgatgtttttaacaagttcagggatcgaaatgggcacttcattcagacgctcaagactgatctccagggaatgttgagcttgtatgaagctgcacatttcagagtccatggagaaggcatccttgacgacgcacttgctttcactaccacttatctggagtccatagtccccaatttaagccctcctcttgcagcccaaatcagtcgcaccttaaggcaaccgctgagaaagagcttggcgagagtggaggcaagacattttatctccatttaccaagaagatacttcccacaatgaagtactactaacctttgcaaagttggacttcaacctgttgcagaaactgcaccagaaggagctaaaatatatctcattgtggtggaaagatttagattttgtaaacaagctcccttttacacgagacagggtcgtggagggttacttttggatattgggagtgtattttgagcctcagtaccatcgtgccagaaagtttgtaactaaagtaatcaatgtagtatcagtaatagatgatatatatgacgcgtacggcacactggaagaacttgtagtctttactgatgcaattaacaggtgggatattgattgcatagaccaactccccgagtacatgaaagtgtgctacaaagcactcttaaatgtgtatgaagaaatcgaaagggcattatcagagcaaggaagatcttaccgccttcattatgccaaagaagcaatgaagaagcttgtccaagcatacttggttgaagccaattggatgaacaaaaattatgtaccaacaatggatgagtatatgagcattgctttggtatcttgtgcctaccctctgcttacagttacatcttttgttggcatgggtgatattgcaacaaaggaggtctttgactgggcttctaatgaccctaaaattgtgagagttgcatctatcatttgtaggttgatggatgacattgtatcccatgagttcgagcagaaaagagggcatattgcatctagtgttgagtgctatatgaagcaaaatggtgtctcagaggaagcaacaagagatgaattcaataaacaaatagttgatgcttggaaggatataaatgaggaacatcttcaaccaaattatgtaccaatgcctttccgtacacgtgtggttaattctgctcgtattatggattacttatacaaggatgatgatgaatacacacatgtaggagaattaatgaaaggttccgttgcggctctattgattgatccagcatag

SEQ ID NO: 644 - DNA, 1185 bp, Ricinus communis
  (+)-delta-cadinene synthase isozyme A
atgggaaagagagataagaaacagaggcatcataatcaacacagaagcagagtagcttcttactacaacacagaacaagaagatgatggttatagctattcacagtcttccttacctaatgaagactcagacgcagaacctgatgatgttgaagaagaagaagaagaagaagaagagaaagaggacactagtgatgcaaaagcatctaatgacgttccttcaaagtttcttctttaccaacaatctgtacagtcgcccaaaggagatataagctatttgcaaaagttctttttactgtatgttggtgggaggttgcctcttcatttccaggaagatttctgcgggactgctcttttaagtacagaatggctacgtagtgactcaagacggactgctgtaggagtggatttagaccttgaggcactaaattggtgcatggcgaacaatgtaaataaaattggggctgatggatattccagaatatccctctttcatggtaatgtcttgcaaccttctgatgctgaattagtcaggtttgagccccaagatctgataagtaacatcaaattgggagagcagggagacaattctgagaatactgcactggaatctgctctccaagtgggttcatcagcttctgttagtgataagtacttgaaaagaaactttcagttaccagcaagagacattgtgtgtgcctttaactacagctgctgttgtctccataaacgagcagatctggttttatatttcaaacatgttcttgatgccttgtccaaaaagggtggtttatttgtgatggatttatatggtggaacatcatcagaaggcaagctaaggcttcagagaagatttccaaattttacgtatatctgggagcaagctgaatttaacataattgagcgcaaaacaaggatcagcctccactttcatcttcagaagcagcagaagaagcttcgccatgcattttcatacagctggaggctgtggtcattgccagagatcagagactgcttagaagaggctggatttaaatccattcacttctggcttcggaggatgccagacagcaaagacaacaggagcgtagagggattcgggttcgggcgagacataaagtacgaggaggtcaaaacttttgaacaagaagattcttggaatgcatacattgtagctgttgcatag

SEQ ID NO: 645 - skipped

SEQ ID NO: 646 - DNA, 1994 bp, Ricinus communis
  casbene synthase, chloroplastic
actcagcagccgcctctcctaccccaattagcacagaagatttggtggttcctctccttgtgaaacatggcattgccatcagctgctatgcaatccaaccctgaaaagcttaacttatttcacagattgtcaagcttacccaccactagcttggaatatggcaataatcgcttccctttcttttcctcatctgccaagtcacactttaaaaaaccaactcaagcatgtttatcctcaacaacccaccaagaagttcgtccattagcatactttcctcctactgtctggggcaatcgctttgcttccttgaccttcaatccatcggaatttgaatcgtatgatgaacgggtaattgtgctgaagaaaaaagttaaggacatattaatttcatctacaagtgattcagtggagaccgttattttaatcgacttattatgtcggcttggcgtatcatatcactttgaaaatgatattgaagagctactaagtaaaatcttcaactcccagcctgaccttgtcgatgaaaaagaatgtgatctctacactgcggcaattgtattccgagttttcagacagcatggttttaaaatgtcttcggatgtgtttagcaaattcaaggacagtgatggtaagttcaaggaatccctacggggtgatgctaagggtatgctcagcctttttgaagcttcccatctaagtgtgcatggagaagacattcttgaagaagcctttgctttcaccaaggattacttacagtcctctgcagttgagttattccctaatctcaaaaggcatataacgaacgccctagagcagcctttccacagtggcgtgccgaggctagaggccaggaaattcatcgatctatacgaagctgatattgaatgccggaatgaaactctgctcgagtttgcaaagttggattataatagagttcagttattgcaccaacaagagctgtgccagttctcaaagtggtggaaagacctgaatcttgcttcggatattccttatgcaagagacagaatggcagagattttcttttgggcagtcgcgatgtactttgagcctgactatgcacacacccgaatgattattgcgaaggttgtattgcttatatcactaatagatgatacaattgatgcgtatgcaacaatggaggaaactcatattcttgctgaagcagtcgcaaggtgggacatgagctgcctcgagaagctgccagattacatgaaagttatttataaactattgctaaacaccttctctgaattcgagaaagaattgacggcggaaggcaagtcctacagcgtcaaatacggaagggaagcgtttcaagaactagtgagaggttactacctggaggctgtatggcgcgacgagggtaaaataccatcgttcgatgactacttgtataatggatccatgaccaccggattgcctctcgtctcaacagcttctttcatgggagttcaagaaattacaggtctcaacgaattccaatggctggaaactaatcccaaattaagttatgcttccggtgcattcatccgacttgtcaacgacttaacttctcatgtgactgaacaacaaagaggacacgttgcatcttgcatcgactgctatatgaaccaacatggagtttccaaagacgaagcagtcaaaatacttcaaaaaatggctacagattgttggaaagaaattaatgaagaatgtatgaggcagagtcaagtgtcagtgggtcacctaatgagaatagttaatctggcacgtcttacggatgtgagttacaagtatggagacggttacactgattcccagcaattgaaacaatttgttaagggattgttcgttgatccaatttctatttgaactcaataattccttttttcattttgtacttcaataagttataaatgacccgtgcactagcggtggtgattattgtatttaaattgccttttaaattaatatatgaatcaagaattttatag

SEQ ID NO: 647 - DNA, 2358 bp, Salvea sclarea
  abdenediol diphosphate synthase
atgacttctgtaaatttgagcagagcaccagcagcgattacccggcgcaggctgcagctacagccggaatttcatgccgagtgttcatggctgaaaagcagcagcaaacacgcgcccttgaccttgagttgccaaatccgtcctaagcaactctcccaaatagctgaattgagagtaacaagcctggatgcgtcgcaagcgagtgaaaaagacatttcccttgttcaaactccgcataaggttgaggttaatgaaaagatcgaggagtcaatcgagtacgtccaaaatctgttgatgacgtcgggcgacgggcgaataagcgtgtcaccctatgacacggcagtgatcgccctgatcaaggacttgaaagggcgcgacgccccgcagtttccgtcatgtctcgagtggatcgcgcaccaccaactggctgatggctcatggggcgacgaattcttctgtatttatgatcggattctaaatacattggcatgtgtcgtagccttgaaatcatggaaccttcactctgatattattgaaaaaggagtgacgtacatcaaggagaatgtgcataaacttaaaggtgcaaatgttgagcacaggacagcggggttcgaacttgtggttcctacttttatgcaaatggccacagatttgggcatccaagatctgccctatgatcatcccctcatcaaggagattgctgacacaaaacaacaaagattgaaagagatacccaaggatttggtttaccaaatgccaacgaatttactgtacagtttagaagggttaggagatttggagtgggaaaggctactgaaactgcagtcgggcaatggctccttcctcacttcgccgtcgtccaccgccgccgtcttgatgcataccaaagatgaaaaatgtttgaaatacatcgaaaacgccctcaagaattgcgacggaggagcaccacatacttatccagtcgatatcttctcaagactttgggcaatcgataggctacaacgcctaggaatttctcgtttcttccagcacgagatcaagtatttcttagatcacatcgaaagcgtttgggaggagaccggagttttcagtggaagatatacgaaatttagcgatattgatgacacgtccatgggcgttaggcttctcaaaatgcacggatacgacgtcgatccaaatgtactaaaacatttcaagcaacaagatggtaaattttcctgctacattggtcaatcggtcgagtctgcatctccaatgtacaatctttatagggctgctcaactaagatttccaggagaagaagttcttgaagaagccactaaatttgcctttaacttcttgcaagaaatgctagtcaaagatcgacttcaagaaagatgggtgatatccgaccacttatttgatgagataaagctggggttgaagatgccatggtacgccactctaccccgagtcgaggctgcatattatctagaccattatgctggttctggtgatgtatggattggcaagagtttctacaggatgccagaaatcagcaatgatacatacaaggagcttgcgatattggatttcaacagatgccaaacacaacatcagttggagtggatccacatgcaggaatggtacgacagatgcagccttagcgaattcgggataagcaaaagagagttgcttcgctcttactttctggccgcagcaaccatattcgaaccggagagaactcaagagaggcttctgtgggccaaaaccagaattctttctaagatgatcacttcatttgtcaacattagtggaacaacactatctttggactacaatttcaatggcctcgatgaaataattagtagtgccaatgaagatcaaggactggctgggactctgctggcaaccttccatcaacttctagacggattcgatatatacactctccatcaactcaaacatgtttggagccaatggttcatgaaagtgcagcaaggagagggaagcggcggggaagacgcggtgctcctagcgaacacgctcaacatctgcgccggcctcaacgaagacgtgttgtccaacaatgaatacacggctctgtccaccctcacaaataaaatctgcaatcgcctcgcccaaattcaagacaataagattctccaagttgtggatgggagcataaaggataaggagctagaacaggatatgcaggcgttggtgaagttagtgcttcaagaaaatggcggcgccgtagacagaaacatcagacacacgtttttgtcggtttccaagactttctactacgatgcctaccacgacgatgagacgaccgatcttcatatcttcaaagtactctttcgaccggttgtatga

SEQ ID NO: 648 - DNA, 2355 bp, Salvea sclarea
  labdenediol diphosphate synthase
atgacttctgtaaatttgagcagagcaccagcagcgattatccggcgcaggctgcagctacagccggaatttcatgccgagtgttcatggctgaaaagcagcagcaaacacgcgcccttcaccttgagttgccaaatccgtcctaagcaactctcccaaatagctgaattgagagtaacaagcctggatgcgtcgcaagcgagtgaaaaagacatttcccttgttcaaactccgcataaggttgaggttaatgaaaagatcgaggagtcaatcgagtacgtccaaaatctgttgatgacgtcgggcgacgggcgaataagcgtgtcaccctatgacacggcagtgatcgccctgatcaaggacttgaaagggcgcgacgccccgcagtttccgtcatgtctcgagtggatcgcgcaccaccaactggctgatggctcatggggcgacgaattcttctgtatttatgatcggattctaaatacattggcatgtgtcgtagccttgaaatcatggaaccttcaatctgatattattgaaaaaggtgtgacgtacatcaaggagaatgtgcataaacttaaaggtgcaaatgttgagcacaggacagcggggttcgaacttgtggttcctacttttatgcaaatggccacagatttgggcatccaaggtctgccctatgatcatcccctcatcaaggagattgctgacacaaaacaacaaagattgaaagagatacccaaggatttggtttaccaaatgccaacgaatttactgtacagtttagaagggttaggagatttggagtgggaaaggttactgaaactgcagtcgggcaatggctccttcctcacttcgccgtcgtccaccgccgccgtcttgatgcataccaaagatgaaaaatgtttgaaatacatcgaaaacgccctcaagaattgcgacggaggagcaccacatacttatccagtcgatatcttctcaagactttgggcaatcgataggctacaacgcctaggaatttctcgtttcttccagcacgagatcaagtatttcttagatcacatcgaaagcgtttgggaggagaccggagttttcagtggaagatatacgaaatttagcgatattgatgacacgtccatgggcgttaggcttctcaaaatgcacggatacgacgtcgatccaaatgtactaaaacatttcaagcaacaagatggtaaattttcctgctacattggtcaatcggtcgagtctgcatctccaatgtacaatctttatagggctgctcaactaagatttccaggagaagaagttcttgaagaagccactaaatttgcctttaacttcttgcaagaaatgctagtcaaagatcgacttcaagaaagatgggtgatatccgaccacttatttgatgagataaagctggggttgaagatgccatggtacgccactctaccccgagtcgaggctgcatattatctagaccattatgctggttctggtgatgtatggattggcaagagtttctacaggatgccagaaatcagcaatgatacatacaaggagcttgcgatattggatttcaacagatgccaaacacaacatcagttggagtggatccagatgcaggaatggtacgacagatgcagccttagcgaattcgggataagcaaaagagagttgcttcgctcttactttctggccgcagcaaccatattcgaaccggagagaactcaagagaggcttctgtgggccaaaaccagaattctttctaagatgatcacttcatttgtcaacattagtggaacaacactatctttggactacaatttcaatggcctcgatgaaataattagtgccaatgaagatcaaggactggctgggactctgctggcaaccttccatcaacttctagacggattcgatatatacactctccatcaactcaaacatgtttggagccaatggttcatgaaagtgcagcaaggagagggaagcggcggggaagacgcggtgctcctagcgaacacgctcaacatctgcgccggcctcaacgaagacgtgttgtccaacaatgaatacacggctctgtccaccctcacaaataaaatctgcaatcgcctcgcccaaattcaagacaataagattctccaagttgtggatgggagcataaaggataaggagctagaacaggatatgcaggcgttggtgaagttagtgcttcaagaaaatggcggcgccgtagacagaaacatcagacacacgtttttgtcggtttccaagactttctactacgatgcctaccacgacgatgagacgaccgatcttcatatcttcaaagtactctttcgaccggttgtatga

SEQ ID NO: 649 - DNA, 1728 bp, Salvea sclarea
  sclareol synthase
atgtcgctcgccttcaacgtcggagttacgcctttctccggccaaagagttgggagcaggaaagaaaaatttccagtccaaggatttcctgtgaccacccccaataggtcacgtctcatcgttaactgcagccttactacaatagatttcatggcgaaaatgaaagagaatttcaagagggaagacgataaatttccaacgacaacgactcttcgatccgaagatataccctctaatttgtgtataatcgacacccttcaaaggttgggggtcgatcaattcttccaatatgaaatcaacactattctagataacacattcaggttgtggcaagaaaaacacaaagttatatatggcaatgttactactcatgcaatggcatttaggcttttgcgagtgaaaggatacgaagtttcatcagaggagttggctccatatggtaaccaagaggctgttagccagcaaacaaatgacctgccgatgattattgagctttatagagcagcaaatgagagaatatatgaagaagagaggagtcttgaaaaaattcttgcttggactaccatctttctcaataagcaagtgcaagataactcaattcccgacaaaaaactgcacaaactggtggaattctacttgaggaattacaaaggcataaccataagattgggagctagacgaaacctcgagctatatgacatgacctactatcaagctctgaaatctacaaacaggttctctaatttatgcaacgaagattttctagttttcgcaaagcaagatttcgatatacatgaagcccagaaccagaaaggacttcaacaactgcaaaggtggtatgcagattgtaggttggacaccttaaactttggaagagatgtagttattattgctaattatttggcttcattaattattggtgatcatgcgtttgactatgttcgtctcgcatttgccaaaacatctgtgcttgtaacaattatggatgattttttcgactgtcatggctctagtcaagagtgtgacaagatcattgaattagtaaaagaatggaaggagaatccggatgcagagtacggatctgaggagcttgagatcctttttatggcgttgtacaatacagtaaatgagttggcggagagggctcgtgttgaacaggggcgtagtgtcaaagagtttctagtcaaactgtgggttgaaatactctcagctttcaagatagaattagatacatggagcaatggcacgcagcaaagcttcgatgaatacatttcttcgtcgtggttgtcgaacggttcccggctgacaggtctcctgacgatgcaattcgtcggagtaaaattgtccgatgaaatgcttatgagtgaagagtgcactgatttggctaggcatgtctgtatggtcggccggctgctcaacgacgtgtgcagttctgagagggagcgcgaggaaaatattgcaggaaaaagttatagcattctactagcaactgagaaagatggaagaaaagttagtgaagatgaagccattgcagagatcaatgaaatggttgaatatcactggagaaaagtgttgcagattgtgtataaaaaagaaagcattttgccaagaagatgcaaagatgtatttttggagatggctaagggtacgttttatgcttatgggatcaacgatgaattgacttctcctcagcaatccaaggaagatatgaaatcctttgtcttttga

SEQ ID NO: 650 - DNA, 1656 bp, Santalum album
  santalene synthase
atgtcaactcaacaagtttcatcagagaacattgttcgtaacgctgcgaatttccatcctaatatatggggaaaccatttcctcacatgtccttctcagacgattgatagttggactcaacagcaccacaaagaactgaaagaagaggtgaggaaaatgatggtgtctgatgcaaataaacctgcccagagattgcgcttgattgatactgtccaaaggctaggtgtggcttaccactttgaaaaggagattgatgatgcattggagaaaataggtcatgacccttttgatgataaagatgatctctacattgtctctctttgttttcgattgctgaggcagcatggaattaagatatcatgtgatgtgtttgagaagtttaaagatgacgatggaaaattcaaggcatcattgatgaatgatgttcaaggcatgctaagtttatatgaggcagcacacctagccattcacggagaagatattttagatgaagcaattgttttcacgaccactcaccttaagtcaacggtatctaattctcctgtaaactctacttttgctgaacaaatacgtcattctctcagagttcctctccgtaaagctgtacctaggttagagtcgaggtatttcttggatatctattcaagagatgatttgcacgataaaactttgctcaatttcgcaaagttagactttaatatactacaagcaatgcaccagaaggaagcaagtgagatgaccaggtggtggagagattttgacttccttaaaaagctgccttatataagagacagagtcgtggagctatatttttggattctggtgggagtgtcttatcagcccaaattcagcactggtagaatttttttgtccaaaataatatgccttgagaccctcgtagatgatacatttgacgcctacggtacttttgacgagctcgcaatctttactgaagcagttacaagatgggaccttggccacagagatgcactaccagaatacatgaaattcattttcaagacactcattgatgtctacagtgaagctgagcaagaactggcaaaggaagggagatcatacagcatacactatgcaatacgatcgttccaagaactagttatgaagtacttctgcgaagccaagtggttaaataaaggttatgttccgagcctggacgattataaatcagtttcattaagaagtatcggttttttaccgatagcggtagcttccttcgttttcatgggtgatattgcaactaaggaggtctttgaatgggaaatgaataaccctaagatcataatagccgcagaaacgattttcagattcctggatgacatagcaggccataggtttgagcaaaagagagaacatagtccatcagctattgaatgctacaagaatcaacatggagtgtctgaggaagaggcagttaaagcgttgtcgttagaagttgctaatagttggaaagatataaatgaggagctgcttctcaacccaatggctattcctttacctctgcttcaggtgattcttgatctctcacgttcggccgattttatgtacggtaatgctcaagatcgcttcacgcattcaacgatgatgaaagaccaagttgatttggtgctgaaggaccccgttaagcttgacgattaa

SEQ ID NO: 651 - DNA, 1650 bp, Santalum album
  santalene synthase
atggctaccgataatgacagctctgaaaaccgtcgtatgggtaattacaagccgtccatctggaactacgacttcctgcagtccctggctacccgccacaatatcatggaagagcgccacttgaaactggcggagaaactgaaaggccaggtgaagtttatgtttggtgccccgatggagccgctggccaaactggagctggttgatgttgttcagcgcctgggtctgaatcatcgcttcgagacggagattaaggaggccctgttcagcatctacaaggatgagagcaacggttggtggtttggccacctgcatgccaccagcctgcgttttcgcctgctgcgccagtgtggtctgttcattccgcaagacgttttcaagacgttccaaagcaagaccggcgagttcgacatgaaactgtgcgacaacgtcaagggtttgctgagcctgtacgaggcttcctttctgggctggcgtgacgaaaatatcctggacgaagcgaaagcttttgccacgaagtacctgaagaacgcatgggaaaacattagccagaagtggctggcgaaacgcgtgaagcatgcgttggcactgccgttgcactggcgtgtgcctcgtattgaagcacgctggtttgttgaggcgtacggcgaggaggaaaatatgaatccgaccttgctgaagctggctaagttggattttaacatggtgcaatctattcaccaaaaggaaatcggtgaattggcacgttggtgggtcaccaccggtctggacaaactggcattcgcgcgcaataatttgctgcaaagctacatgtggagctgcgcgatcgcatctgacccgaagtttaagctggctcgcgaaaccatcgtggagatcggttccgtgctgactgttgtggatgacgcctacgatgtttacggtagcatggacgaactggacttgtataccaatagcgtggagcgttggagctgtacggaaatcgataagctgccgaatacgctgaaactgatttttatggctatgtttaacaagaccaatgaagttggtctgcgtgttcagcacgagcgtggttactccggcatcaccaccttcattaaggcatgggtcgaacagtgtaagagctatcaaaaagaagcgcgctggtatcatggtggtcacacgcctccgctggaagagtactccttgaatggcttggtgagcattggtttcccgctgctgctgattaccggctacgtcgccattgccgaaaacgaagcagcgctggacaaagtgcatccgctgccggatctgctgcactatagctctctgctgagccgcctgatcaacgacatgggtacgagcagcgacgagctggagcgcggcgataatctgaaaagcatccaatgctatatgaatcagaccggcgcgagcgagaaggtggcgcgcgagcacatcaagggcatcattgaggagaattggaagattctgaacgaatgttgcttcgaccaaagccaatttcaagagccgttcgtgacgttcaacctgaacagcgttcgtggttcccatttcttttacgagtttggtgacggtttcggtgtgacgaatagctggaccaaggttgacatgaagagcgtcctgattgatccgattccactggatgaagaataatga

SEQ ID NO: 652 - DNA, 1656 bp, Santalum album
  santalene synthase
atggcaaccttgaagactgacaccgacgctagcgagaatcgtcgcatgggcaactataaaccgagcatttggaactacgatttcctgcaaagcctggctacccaccacaatatcgtggaggagcgtcacctgaaactggcagaaaaattgaaaggccaagtgaaattcatgttcggcgcaccgatggaaccgctggcgaaactggagctggtcgacgtggtccaacgcctgggtctgaatcacctgtttgaaaccgaaattaaagaggcactgttcagcatctataaggacggttcgaacggttggtggttcggtcacctgcatgcaaccagcctgcgttttcgtctgctgcgtcagtgtggcctgttcattccgcaggacgtctttaaaacctttcagaacaaaaccggcgagtttgacatgaagctgtgggacaatgtgaaaggcctgttgagcctgtatgaggcgagctacctgggttggaagggtgaaaacatcctggatgaagcaaaggcatttaccaccaagtgtctgaagagcgcgtgggaaaatatctctgagaaatggttggcgaaacgtgtgaagcacgcgctggcgctgccgctgcactggcgcgttccgcgcatcgaagcgcgctggtttatcgaagtttatgaacaggaagctaatatgaacccgaccctgctgaagctggcgaagctggatttcaacatggttcaaagcattcatcaaaaggagatcggcgagctggcccgctggtgggtgaccacgggtttggacaagctggactttgcacgtaataatctgttgcaaagctacatgtggagctgcgctatcgcatccgacccgaaatttaagttggcacgtgaaaccatcgttgaaattggtagcgtgctgactgtggtggatgacggttacgatgtttacggtagcatggacgaactggacctgtacacgtcgagcgtcgagcgctggagctgtgtcaaaattgataagctgccgaacacgctgaaactgatcttcatgagcatgttcaacaaaaccaacgaagtgggcctgcgcgtgcagcacgaacgtggctataatagcattccgacgtttatcaaggcatgggtggagcaatgtaaaagctaccaaaaagaggcccgttggtttcatggcggccataccccgcctctggaggaatatagcctgaacggcctggtgtccattggttttccgctgctgctgatcaccggctacgtggcaatcgcggaaaatgaagccgcgctggacaaggtccatccactgccggacctgttgcattatagctctctgctgagccgtctgatcaatgatatcggtacgagcccggacgagatggctcgtggtgacaacctgaaaagcatccattgttatatgaacgagacgggtgcgtccgaagaggtcgcccgcgagcatatcaagggcgttattgaggagaactggaaaatcctgaatcaatgttgcttcgatcaaagccagttccaagagccgttcatcacgttcaatctgaacagcgttcgcggtagccactttttctacgaatttggcgacggttttggcgttacggacagctggaccaaagttgatatgaaatccgttctgatcgacccgatcccgttgggtgaagagtag

SEQ ID NO: 653 - DNA, 2157 bp, Santalum album
  santalene synthase
acaaaataaatctcttgttctgttctttggatctcgttttcttcccctcagctctctcactaatggattcttccaccgccaccgccatgagagctccattcattgatcatactgatcatgtgaatctcagaactgataacgattcctcagagaatcgaaggatggggaattataaacccagtatttggaactatgattttttgcaatcgcttgcgactcgccacaatattatggaagagaggcatctaaagctagctgagaagctgaagggccaagtgaagtttatgtttggggcaccaatggagccgttagcaaagctggagcttgtggatgtggttcaaaggctcgggctaaaccaccgatttgagacagagatcaaggaagcgctatttagtatttataaggatgagagcaatggatggtggtttggccacctccatgcgacatctctccgatttaggctgctacgacagtgtgggctttttatcccccaggatgtgtttaaaacatttcagagcaaaactggtgaatttgatatgaaactgtgtgacaatgtaaaaggattgctgagcttgtatgaagcttcattcttggggtggagggatgaaaacatcttagatgaagccaaagccttcgccaccaagtacttgaaaaatgcatgggaaaacatatcccaaaagtggcttgccaaaagagtgaagcatgcactggctttgcctttgcactggagagtccctagaatcgaagctagatggttcgttgaggcatatggggaagaagagaatatgaacccaacacttctcaaacttgcaaaattggactttaacatggtgcaatcaattcatcagaaagagattggggaattagcgaggtggtgggtgactacggggttggataagttagcgtttgctaggaataatttactgcaaagctatatgtggagctgcgcgattgcttccgacccaaagttcaaacttgctagagaaactattgttgaaatcggaagtgtactcacagttgttgacgatgcatatgacgtctatggttcaatggatgaacttgatctctacacgaactccgttgaaaggtggagctgtacagaaattgacaagttaccaaacacattaaaattgatttttatgtctatgtttaacaagaccaatgaagttggccttcgagtccagcatgagcgaggctacagtggcatcactacttttatcaaagcgtgggttgaacagtgtaaatcgtaccagaaagaagcaagatggtaccatgggggacacacgcctccactggaagaatatagcttgaatggactggtttccataggattccctctcttgttgatcacaggctacgtggcaatcgctgagaacgaggctgcactggataaagtgcacccccttcctgatcttctgcactactcctccctccttagtcgcctcatcaatgatatgggaacctcttcggacgagttggaaaggggagataatctgaagtcaattcaatgttacatgaaccaaactggggcttctgagaaagttgctcgtgagcacataaagggaataatcgaggaaaactggaaaatactgaatgagtgttgctttgatcaatctcagtttcaggagccttttgtaacattcaatttgaactctgttcgagggtctcatttcttctacgaatttggagatggctttggggtgacggatagctggacaaaggttgatatgaagtctgttttgatcgatcctattcctctcgacgaggagtagaaaactcaaagcttgtgcttggtttacggtaatagtgattcagtataaatataaaaatcggacgaacttgaggaatatgtgaggcataactatttttaatgatcatgagttaaataattaagaaatatctattcggctcatgattcttgagtatatattattccttatgcgttatatttccatcaaataattagtccgctcctgtaagtcgactgtaacattactctaagggtcgctattggttttatgttatattaagtctactagtttgaagtgatggaataaatgtttgtttttaagggggttatgcactatgttctcggttgccttttactaataaattttttatgaaactcaaaaaaaaaaaaaaaaaaaaaaaaaaaaa

SEQ ID NO: 654 - DNA, 1725 bp, Santalum album
  santalene synthase
actaatggattcttccaccgccaccgccatgacagctccattcattgatcctactgatcatgtgaatctcaaaactgatactgatgcctcagagaatcgaaggatgggaaattataaacccagcatttggaattatgattttttacaatcacttgcaactcatcacaatattgtggaagagaggcatctaaagctagctgagaagctgaagggccaagtgaagtttatgtttggggcaccaatggagccgttagcaaagctggagcttgtggatgtggttcaaaggcttgggctaaaccacctatttgagacagagatcaaggaagcgctgtttagtatttacaaggatgggagcaatggatggtggtttggccaccttcatgcgacatctctccgatttaggctgctacgacagtgtgggctttttattccccaagatgtgtttaaaacgttccaaaacaaaactggggaatttgatatgaaactgtgggacaacgtaaaagggctgctgagcttatatgaagcttcatacttgggatggaagggtgaaaacatcctagatgaagccaaggccttcaccaccaagtgcttgaaaagtgcatgggaaaatatatccgaaaagtggttagccaaaagagtgaagcatgcattggctttgcctttgcattggagagtccctcgaatcgaagctagatggttcattgaggtatatgagcaagaagcgaatatgaacccaacactactcaaactcgcaaaattagactttaatatggtgcaatcaattcatcagaaagagattggggaattagcaaggtggtgggtgactactggcttggataagttagactttgctaggaataatttactgcagagctatatgtggagctgcccgattgcttccgacccgaagttcaaacttgctagagaaactattgtcgaaatcggaagtgtactcacagttgttgacgatggatatgacgtctatggttcaatggacgaacttgatctctacacaagctccgttgaaaggtggagctgtgtgaaaattgacaagttgccaaacacgttaaaattaatttttatgtctatgttcaacaagaccaatgaggttggtcttcgagtccagcatgagcgaggctacaatagcatccctacttttatcaaagcgtgggttgaacagtgtaaatcataccagaaagaagcaagatggttccacgggggacacacgcctccattggaagaatatagcttgaatggacttgtttccataggattccctctcttgttaatcacaggctacgtggcaatcgctgagaacgaggctgcactggataaagtgcacccccttcctgatcttctgcactactcctccctccttagtcgcctcatcaatgatataggaacgtctccggatgagatggcaagaggcgataatctgaagtcaatccattgttacatgaacgaaactggggcttccgaggaagttgctcgtgagcacataaagggagtaatcgaggagaattggaaaatactgaatcagtgctgctttgatcaatctcagtttcaggagccttttataaccttcaatttgaactctgttcgagggtctcatttcttctatgaatttggggatggctttggggtgacggatagctggacaaaggttgatatgaagtccgttttgatcgaccctattcctctcggcgaggagtagtaagctcgaag

SEQ ID NO: 655 - DNA, 1680 bp, Santalum album
  sesquiterpene synthase
atggaaaatcaaaaagtgcctatttcttctgtccccaacctcaaggaactttctcgccccattgctaattttccccccagcatttggggtgaccgtttcatcaactacgcctgtgaagatgagaatgagcaagcacagaaagagagacaagttgaagagttaaaagagcaggtaaggagggagttagctgctaccgtcgataagcccttgcagcagctaaatatcatcgatgcaactcaacggctgggaattgcataccacttcgaaaatgagattgaagaatcactcgaacatatctacctccacacctatgtggagaataattgttttcagggctcccacgatctttatagtgttgctctttggtttcgtctcctaagacaagatggttacaaggtttcatgcgatgtattcgacaagtttagagactatgaggataacttcaaaaatagcttaatggaagacgcaaaaggcctattagaattgtatgaagcaactcacctaagcgtgcatggagaagagatgctagatgatgctctagagtttgctaagactcgcctcgagtcaattgtaaatcatttgaattaccctctagctgaacaagttcgccatgccctatatcggccactacgcaaaggcttgcctagactagaggctgtatacttctttcggatctatgaagcatatgattcccataacaaagctttattgaagctggcaaaacttgatttcaacttacttcagtctttgcacaagaaagagctcagtgacatggctagatggtggaagtctttggattttgctgcaaaatttccttttgcaagggacagactagttgagggttatttttgggtactgggggtgtactttgagccacagtactcccttgcacggaaaattataatcaaagtattcactatgatttctactatcgatgacatttatgatgcatacggtacattagatgagttagagctatttactaaagcaatgcaaaggtgggatgttgggagcttggatcagcttccagagtatatgaaaccctgctataaatcaattttggatgtttacaatgaaattgaggaagagatggacaatcaaggaagcctgtttcggatgcactacgctaaagaagtgatgaagaaattagtggaaggctatatggatgaagccaaatggtgccatgagaaatatgtgcccacgttcgaagaatacatgcccgtcgcactggtgacatctggctacacatttctcacgactatatcataccttggaatgggcgagattgcgtcgaaggaagcatttgattggctttttagtcacccacccgttatagaagcttcggaatctgtttgtaggcttatggatgatatgagatcccacaagtttgagcaagagagaggacatgttgcatcaggtatagaatgttacatgaagcagtatggtgttacagaagaagaggctcatgatgaatttcgtaagcaattggtgaaagcttggaaggacataaatgaagagtgcctaaggccatatcgtgtgccgaaacctcttttgatgcgcattctcaaccttacacgagtgatagatgttatttacaagaacgaagacggctacacacatgtgaagaaggccatgaaagataacattgcatccctacttatagatcccatgattgtttga

SEQ ID NO: 656 - DNA, 1855 bp, Santalum austrocaledonicum
  sesquiterpene synthase
acacagctcccgtctatgctttgaagcactccaaacatcatactgaacttttcatttgccctcatggaaaatcaaaaagtgcctatttcttctgtccccaacctcaaggaactttctcgccccattgctaatttccctcccagcatttggggtgaccgtttcatcaactacacctgtgaagatgagaatgagcaagcccagaaagagagacaagttgaagaattaaaggagcaggtgaggagggagttagctgctaccgtcgataagcccttgcagcagctaaatatcatcgatgcaactcaacggctgggaatcgcataccacttcgaaaatgagattgaagaatcactcgaacatatctacctccacacctatgtgaagaataattgttttcagggctcccacgatctttacagtgttgctctttggtttcgtctactaagacaagatggttacaaggtttcatgcgatgtattcgacaattttagagactatgagggtaacttcaaaaacagcttaatggaagacgcaaaaggcctattagaattgtatgaagcaactcacctaagcgtgcatggagaagagatgctagatgatgctctagagtttgctaagactcgcctcgagtcaattgtaaatcatttgaattaccctctagctgaacaagttcgccatgccctataccggccactacgcaaaggcttgcctagactagaggctgtatacttctttcggatctatgaagcatatcattcccataacaaagctttattgaagctggcaaaacttgatttcaacttacttcagtctttgcacaggaaagagctcggtgacatggctagatggtggaggtctttggatttcgctacaaaatttccttttgcaagagatagactagttgagggttatttttggatattgggggtttactttgagccacagtactcccttgcacgggaaattacaaccaaagtattcgctatgatttccactatcgatgatatttatgatgcatatggcacattagatgagttaaagctatttactgaagcaatccaaaggtgggatgttgggagcttggatcagcttccagagtatatgaaaccctgctataaatcaattttggatgtttacaatgaaattgaggaagagatggccaatcaaggaagcctgtttcggatgcactacgctaaagaagtgatgaagacaatagtcgaaggctatatggatgaagccaaatggtgccatgagaaatatgtgcccacgttccaagagtacatgtcccttgcactggtgacatctggctacacatttctcacgactatatcgtaccttggcatgggcggaattgcctcgaaggaagcatttgaatggctttttagtcacccacccattattgaagcttcggaatctatttgtaggcttatggatgatatgagctcccacaagtttgaacaagagagaggacatgttgcatcgggtatagagtgttacatgaagcaatatggtgttatagaggaagaagcacatgatgaatttcataagcgattggtgaaagcatggaaggacataaacgaagggttcctaaggccgtatgccgtgccggaacctcttttgatgcgcatcctcaaccttacacgagtgatggatgttatttacaagaatgaagacagctacacgcatgtgaagaaggccatgaaagataacatcgcatccctacttatagatcccatgattgtttgaatgcatccgttggatttaccgttatataatgtaagtgaaatgccagtttgtggttattaaaataaagagtaatagattttcgttgataaaaaaaaaaaaaaaaaaaaaaaaa

SEQ ID NO: 657 - DNA, 1689 bp, Santalum spicatum
  sesquiterpene synthase
atggaaaatcaaaaagtgcctatttcttctgtccccaacctcaaggacctagatatgatttctcgccccattgccaatttcccccccagcgtttggggcgatcgtttcatcaactacgcctgtgaagatgagaatgaacaagcccagaaagaaagacaagttgaagagctaaaggagcaggtgaggagggagctggctgctgccatcgataagccgttacagcagctgaatatcatcgatgcaactcaacggctaggaattgcttatcacttcgaaaatgagatcgaagaatcacttaaacatatctacctccacacctatgtggagaatacttgttttgagggctccgacgatctctgtagtgttgctctttggtttcgtctactaagacaagatggttacagggtttcatgcgatgtattcaagaagtttagagacagcgaaggtaacttcaaaaacagcttaatggaagacgcaaaaggcctgttagaattgtatgaagcaactcacttaagcgttaatggagaagagatgctagatgatgctctggagtttactaagactcacctcgagttagttgtgagccatttgaattatcctctagccgaacaagttcgccatgccctatatcagccgcaacacaagggcttgcctagactagaggccgtatacttctttcggatctatgaagcttatgattcccataacgaagctttattgaagctggcaaaacttgatttcaacttacttcagtctttgcacatgaaagagctcagtcacatggctaaatggtggaagtctttggatttcgcaacaaaatttccttttgcaagagacagactagttgagggttatttttggatactgggggtgtactttgagccacagtactccctcgcacggaaaattataatcaaagtattcactatgatttctactatcgatgacatttatgatgcatacggtacattagatgagctaaagctatttactaaagcaatccagaggtgggatattgggagcttggatcagcttccagagtatatgaaaccctgctataaatcagttttggacgtttacaatgaaattgaggaagagatggacaatcagggaagcctgtttcggatgcactacgctaaagaagagatgaagaaaatagtggaaggctatatggatgaagccaaatggtgccatgagaaatatgtgcccacgttccaagagtacatgtccgtcgcactggtgacagctggctacacatttctcacgacaatatcgtaccttggaatgggcgaaattgcgtcgaaggaagcatttgattggctttttagtcacccacccattattgaagcttcagaatctgttggtaggcttatggatgatatgagatcccacgagtttgagcaagagagaggacatgttgcatcgggtatagaatgttacatgaagcagtatggtgttacagaggaagaggcacatgataaatttcataagcgattggtgaaagcttggaaggatatcaacgaagggtgcctaaggccgtatcctgtgccgaaacctcttttgatgcgcatcctcagccttacacgagtgatagatgttatttacaagaacgaagactggtacacgcatgtgaagaagcccatgaaagataaaattgcatccctacttatagatcccatgattgtttga

SEQ ID NO: 658 - DNA, 333 bp, Scoparia dulcis
  copalyl diphosphate
atgggatgggtcatacctacctccacttcgccggaagcagatgcaacgtgggagcacggtttgtctgctgatgacgtgaccggcgtcagaccagtcacagaccggtcattcttgtccaccacgtgtcagtttagcatgccgcacgtctgtccttcttcatacaatgacttccttgcaatggttgcgatgaagcctggaatgtatctggccgggactggcgtgctaactccaggagttagcacgccggctctggctagggacgagtgcctggaggctctcatcattccgacgggacggggcgaggcgtgtgacaggctgcctgctgccacctaa

SEQ ID NO: 659 - DNA, 2030 bp, Solanum habrochaites; identical to SEQ ID NO: 608
  sesquiterpene synthase 1
  variation 1721, 1723, 1773, 1832, 1850, 1859, 1880, 1882, 1894, 1901,1904, 1908, 1913, 1926, 1929, 1958, 1959, 1978, 1989, 1997,2004, 2008: n = a or c or t or g

SEQ ID NO: 660 - DNA, 2000 bp, Solanum habrochaites; identical to SEQ ID NO: 609
  sesquiterpene synthase 2

SEQ ID NO: 661 - DNA, 1647 bp, Solanum lycopersicum
  caryophyllene/alpha-humulene synthase
atggcttcttcttctgctaataagtgtcgtcccttggctaattttcacccaactgtttggggatatcatttcctttcttatactcatgaaattactaaccaagaaaaagttgaagttgatgagtacaaagaaacaattagaaaaatgctggtggaagctcctgaaggtagtgaacaaaaacttgtgttgatagacgcgatgcaacgattgggagtggcatatcattttgataatgaaattgaaacatccattcaaaacatttttgatgcatcgtccaaacagaatgataatgacaacaacctttacgttgtgtctcttcgttttcgacttgtgaggcaacaaggccattacatgtcttcagatgtgttcaagcaattcatcaaccaagatgggaaattcaaggaaacgcttactaatgatgtccaaggattattgagtttgtatgaagcgtcacatctgagagtgcgcgatgaggagattcttgaagaagctcttacctttaccaccactcatctcgagtctactgtctccaacttgagcaataataactctcttaaggctgaagtaactgaagcctttagtcagcctattcgcatgactttaccaagggtgggagcaaggaaatacatatccatttacgaaaacaatgatgcacacaaccatttgcttttgaaatttgctaaattggatttcaacatgctgcaaaagttgcaccaaagagagcttagtgaccttacaaggtggtggaaagatttggattttgcaaataaatatccatatgcaagagacaggttggttgagtgttacttctggatattaggagtgtattttgagccaaagtatagtcgtgcgagaaaaatgatgacaaaagtaatccaaatggcctccttctttgatgacacttttgatgcttatgcaacctttgacgaactagaacctttcaacaatgcaatccagagatgggatattaatgcaatcgattcagtaccgccatatctgagacatgcttatcaagctcttctagacatatacagtgaaatggaacaagcgttggccaaagaatttaaatcagatcgtgtatactatgcaaaatatgagatgaaaaagttggtgagagcctattttaaggaagcccaatggttaaacaatgataatcatattccaaaatatgaggaacacatggagaatgcgatggtaagtgctggctatatgatgggagcaacaacttgcttggttggtgtggaggaatttatatccaaagagacttttgaatggatgataaatgaacctttgatagttcgagcttcctcattgattgccagagcaatggacgatattgttggacatgaagttgaacaacaaagagaacatggagcttcacttattgaatgctacatgaaagattatggagtttcaaagcaagaggcttacgttaaattccagaaagaagtcaccaatggatggatggacataaacagagaattcttctgtccagacgtagaagtaccaaagtttgtccttgaacgagtgctaaatttcacacgcgtgataaacacgttatataaagagaaggatgagtacacaaactccaaaggaaaatttaaaaatatgataatttcgttactggttgagtctgtcgaaatatga

SEQ ID NO: 662 - DNA, 2403 bp, Solanum lycopersicum
  copalyl diphosphate synthase
atgtcgatctcagcttcttttttaagatttagcctcactgctcactatcaaccttctccttcttcttctccaccaaatcaacctttcaaattccttaaaagcaacagagaacatgttgaattcaatcgaattttgcaatgtcatgctgtttctagacgtcgtacaaaagattacaaagaggtgcaaagtggttcgttgccggttatcaagtgggacgacatagcagaggaagtggacgaggaaacacacacacttgaggtgtacgatccatcctccaacgaggaccatatcgatgctattcgatcgatgctaggatcaatgggagacggagaaataagcgtctcggcctatgacacagcatgggttgccatggtgaaagatgtgaaggggactgaaactcctcagttcccttcaagccttgagtggattgcgaacaatcagttggctgatggttcatggggtgacaactccattttcttggtttatgatcgtgtcatcaacacattggcttgtgttattgccttgaagtcatggaacttgcatcctgacaagattctacttggaatgtcgtttatgagagagaatttgagcaggattggtgatgagaatgcagagcacatgcctataggcttcgaagtggcatttccttcactcattgagattgctaaaaagttaggcttagattttccttatgattctcccgtcttgcaagacatctatgccagtagacaactaaagcttacaaggataccaaaggacatcatgcacaaagtccccacaactttactccacagtttggaaggaatgacagatttggactggcaaaagttgcttcaatttcagtgcactgatggctcttttctcttctctccatcttccaccgcatatgcacttatgcaaactcaagatcataattgtctcaattatctcaaaaatgctgtccacaaattcaacggcggagttccaaatgtgtatccagtggacctatttgaacatatttggaccgttgatcggttgcaaaggcttggaatttctcggtattttgagctaaaaataaaaaagtgcattgattactttagcaaatattggacaaataaaggaatctgctgggctagaaattccccagttcaagacattgatgacacggctatggcttttagacttttgcgcttgcatggctacgctgtttctgctgacgtattcaaacattttgagagcaaaggcgaatttttctgcttcgtggggcaatcaaatcaagcagtgacaggaatgtataatctttatagggcatctcatgtaatgttctcaggagagaaaatacttgaaaatgcaaaaatatccacttctaattatctaagagaaaaacgagctcaaaatcaactgctagacaagtggatcattactaaagatttacctggagaggtgggatatgcattagatgtgccatggtatgctagcctaccccgcctagaaacaaggttctttttagaacattatggtggtgaagatgacgtgtggattggcaaaacattgtacaggatgccattggttaacaatagcctatacctagagctagcgaaatcggactataacaattgccaagctttgcaccagttcgagtggagaagaattcgcaagtggtactacgaatgcgggctaagagagtttggattaagtgaaaaaaggttgttggttacgtactatttaggcagtgctagtatatttgaggcacaaaggtcgaccgagcgaatggcttgggtcaaaaccgcagctcttatggactgtgtgaggtcttgttttggctccccacaagtatctgcagctgcatttctttgcgaattcgcacactactctagcaccgctctgaattcgaggtacaacacagaagataggctcgttggggtcattcttggaaccctaaatcatctctcactgagtgccttattaacacatggcagagacatccatcactacttgcgtcatgcttgggaaaattggctactgacggtaggagaaggagaaggagaaggagaaggaggtgctgaactcataattcgcaccttaaatttgtgcagtgttcattggatatcggaggagatattgttgtcccatccaacttaccaaaagctattggaaattaccaatagagtttctcaccgactccgtctctacaagggacacagtgaaaagcaggtaggaatgttgacttttagtgaagaaatagaaggtgacatgcaacagctagcagagctcgtgctatctcattcagatgcttccgaattggatgccaatatcaaagacacttttctcactgttgccaaaagtttttactactcagcttattgtgatgatcgaacaattaactttcacatagccaaagtgctatttgaaagagtagtttaa

SEQ ID NO: 663 - DNA, 2024 bp, Solanum lycopersicum; identical to SEQ ID NO: 605
  germacrene C synthase

SEQ ID NO: 664 - DNA, 2539 bp, Solanum lycopersicum
  vetispiradiene synthase
ctcacaattcattcattataaatactcatatctcttctcttacaattccatcatcatttgttcaattctctactacagtctacaaacatataacataacgaaggaaattttttcagaaacaaagagtatagtataaatggcctcagctgctgcattggtgagcaactacagagaggaggagattgttcgccctgttgctgacttctctccaagtctttggggtgatcgtttccattcattctcccttgacaataaggtattgatatattttctacgagtctttcatttttctttatcttgttggatgactttgaatgtaacatacattttcttttttaaaaaaatatttgcagattgctggaaaatatgctcaagaaattgaaactttgaaggaacaatcaagagtaatattatctgcatcttctggaacaacattggctcagaaattggatctgatagacattgttgagcgacttggcttagcttatcattttgagaaacaaatagacgatgtgttggatcaaatttacaaagcagatcctaactctgaggctcaggaatacaatgatttacaaacttcatccatccaatttcgactattgagacaacatggttacaatatctcgccgagtaggtctattatacacatgtttttcattgattgttatatttgtgtttcttgcttacaccaaggaatttttgttttctttttactttttcttactaaaaactaatcttttatttttgtttatgatccagaactttttagcagattccaagatgcaaaaggcaaatttaacgaatctcttagcaacgacatcaagggtcttttgaacttatatgaagcctcacatgtaaggactcatggagaagatattttggaagaggcacttgctttctctactgctcatcttgaatctgcagctccacatttgaagtcacctctgagtaagcaagtgactcatgcccttgagcaatctctccataagagcattccaagagttgagacacgatacttcatctctatctacgaagaggaggaacagaagaatgatttgttgcttcgatttgcaaaactggacttcaacttacttcagatgttgcacaaacaagaactcagtgaagtatcaaggttttgctagtaatttacatgaaaaatattactactattaattgtttatagtgactctcagaatcttatatatatattgttacttactttgtaggtggtggaaagatttggattttgtgacaacccttccatatgctagggatagagcagtcgaatgttacttctggacgatgggagtgtatgctgaaccacaatactctcaggctcgtgtcatgcttgctaagactatagcaatgatttcgatagtagatgacacattcgatgcttatggcattgtaaaagaactggaggtctacaccgatgccatacagaggtatggactacttcttatcatttaattggaagatcccataaaggtgggaaaaaaccatatcaaacaacatgtttatgtccaattttaattttttgcctacaatttattatccgagacaagcctaggagttaaacactagagatttctgcttcttctatgatatatgttcttttaaattgattacttatcaattttattttattttaatttatcaggtgggatattagccatattgatcggctccctgattacatgaaaatcagttacaaagcacttttagatctctacgatgattatgaaacagaactgtcaaaggatggcagatccgatgttgtacactacgctaaagaaagagtatgaatataatcagttatatcagtcacctaatttttttttgaataaatagtgatgtttgaatgtctttacctgttgttgacagatgaaagaaattgtgagaaactattttgtggaagcaaaatggttcattgaaggatacatgccaccagtttctgagtatctttgcaatgcattagctaccagcacttattacttgcttaccactacatcctacttgggcgtgaaatctgctaacaaggaagattttgaatggttggcaaagaaccctaaaattcttgaagccaatgtgacactatgccgagtcattgatgacatagccacctatgatgttgagaagggtagaggtcagattgcaactggaattgaatgttacatgagagattatggcgtatccacagaagaggcaatggaaaaatttgaagagatggctgagatagcatggaaggatgtaaatgaaggaatccttcgaccaactcctgtctctacggagattctcactcgcattctcaatcttgctcgcattattgatgtcacttataaacacaatcaagatggatacaggcatcctgaaaaagtactaaaacctcatattattgcgttgttggtggactctattgaaatttaaatcatctattgttttgtacatttgggagcacttgcttcctatcccctaaaattatagtaagtatttgattgatgccttgttggtatctacgctgctagctaagatgggagtt

SEQ ID NO: 665 - DNA, 1848 bp, Solanum tuberosum
  putative vetispiradiene synthase 4
atttctctaagcacaaaaccaacaaaattaacacttctttttcacaagctaactgtagaagaaattaaatggccctagctgctgcagtgatgagtaactacggagaggaggagattgttcgccctgttgctgacttctctccaagtctttggggtgatcgtttccattatttctccctcgataatcaggttgaaaaagagtatgctcaagagattgaaacattgaaagagcaaacaaggagtatgttgttagctgcgagtggaatgacattggctgagaagttgaatctgatagacattgttgagcgccttggcttagcttaccattttgagaaacaaatagaagacatgttggatcaaatttacaaagcacatcctaactttgagagtcatgaatacagtgacttaactactttatccgttcagtttcgactactgagacaacatggttacaatatctctccaaaaatttttagcagataccaagatgcaaagggaaaatttaacgaaccccttagcaacgacatcaaaggtctattgaacttatatgaagcttcacatgtaaggactcatggagaagacatcttagaagaggcacttgctttctccactgctcatcttgaatctgcagctccacatttgaagtcacctctgagtaagcaagtcacacatgcccttgagcaatctctccataagagcattccaagagttgagacacgatacttcatctctatctacgaagaggaggaacataagaatgatgtgttgcttcgatttgcaaaactggacttcaacttacttcagatgttgcacaaacaagaactcagtgaagtatcaaggtggtggaaagatttggattttgtgacaacacttccatatgctagggatagagcagtcgaatgttacttttggaccatgggagtgtatgctgaacctcaatactctcaggctcgtgttatgcttgctaagactatagcaatgatttctatagtagatgacacattcgatgcttatggaatcgtaaaagaactcgaggtttacaccgatgccatacagaggtgggatatcagccaaattgatcggctcccagattacatgaaaatcagttataaagcacttctagatctctacaacgattatgaaacagagttgtcaatggatggtagatccgatgttgttcactacgccaaagaaagaatgaaagaaatcgtgagaaactattttgtggaagcaaaatggttcattgaaggatacatgccacctgtttctgagtatcttagcaatgcattagctactagcacttattacttgcttacgacaacatcctacttgggcgtgaaatctgctaacaaggaagattttgaatggttggctaagaaccctaaaatccttgaagccaatgtgactttatgtcgagtcattgatgatatagcaacctatgaagttgagaagggtagaggtcagattgcaactggaattgagtgttatatgagggattatggcgtatcaacagaagtagcaatggaaaaattccaagagatggctgagatagcatggaaggatgtaaatgaaggaattcttcgaccaacacctatctctacagaaatccttactcgtattctcaatctggctcgtattatagatgtcacttacaagcacaatcaagatggatacactcatccagagaaggttctaaaacctcacattatcgctttgttggtagattctattgaaatttaaattatcaattcaccaaggaatacttggtacttctcagtcccttaaataagtaattggtgatatcgtgcaatgaagtaactttcttaaaaaaaaaaaaaaaaaaaaaaaa

SEQ ID NO: 666 - DNA, 1944 bp, Solanum tuberosum
  vetispiradiene synthase
gaaagaaagaaaattctctctgttttttccacaagcaaagagtacacacactagaaatgaccccagctgctgtagtaatgagtaactacggagaggaggagattgttcgccccatagctgacttctctccaagtctttggggtgatcgttttcattcattctccctcgacaatcagattgctggaaaatatgctcaagagatcgaaactttgaaggaacaatcaagaattatattatctgcatcttctcgaagaacattggctgagaaattggatctgatagacattgttgagcgccttggcattgcttatcattttgaaaaacaaatagatgatatgttggatcaattttacaaagcagatcctaactttgaggctcacgagtacaatgatttacaaactttatccgttcaatttcgactattgagacaacatggttacaatatctccccaaaactttttattagattccaagatgcaaaaggcaaatttaaagaatctctttgtaacgacatcaagggtcttttgaacttatacgaagcctcgcatgtaaggactcatggagaagatattttggaagaggcacttgctttctctactgctcatcttgaatctgcagctccacatttgaagtcacctctgagtaagcaagtgacacatgcccttgagcaatctctccataagagcattccaagagttgagacacgctacttcatctctatctacgaagaggaggaacagaagaatgatgtgttgcttcaatttgcaaaactggacttcaacttacttcagatgttgcacaaacaagaacttagtgaagtatcaaggtggtggaaagatttggattttgtgacaacacttccatatgctagggatagagcagtggaatgctacttttggacgatgggggtgtatgctgaacctcaatactctcaggctcgtgtcatgcttgctaagactatagcaatgatttctatagtagatgacacattcgatgcttatggcattgtcaaagaacttgagatctacaccgatgccatacagaggtgggatattagccaaattgatcggctccctgattacatgaaaatcagttacaaagcacttttagatctctacaatgattatgaaatggagttgtccaaggatggtagatctgatgttgttcactacgcgaaagaaagaatgaaagaaatcgtgagaaactattttgtggaagcaaaatggttcattgaaggatatatgccgccagtctctgagtatcttagcaatgcattagctaccagcacttattacttgcttacgactacatcttatttgggcatgaagtctgctaacaagcaagattttgaatggttggccaagaaccctaaaattcttgaggctaatgtgacgttatgccgagtcatagatgacatagccacctatgaggttgagaagggtagaggtcagattgccactggaattgaatgttacatgagagattatggtgtatccacagaaaaggccatggaaaaattccaagaaatggctgagacagcatggaaggatgtaaatgaaggaatccttcgaccaactcccgtctctacagagattctcactcgcattctcaatcttgctcgcattatcgatgttacttataagcacaatcaagatggatacactcatccggaaaaagtactaaaacctcatattattgcgttgttggtggactctattgaaatttaaatcatcgattgttttgtacatctgggagcacttgcttcccatcccctaaaattataagtatttgattgatgccttgttggtatctatgctgctaggcgctagctaagataggagttgctggagatacatgttatagtgcagtgcagttaattccttaatttttttttgtatcattattgacattttaaatatatatatatatatcactgctttttat

SEQ ID NO: 667 - DNA, 1976 bp, Solidago canadensis
  germacrene A synthase
aaaattttaatcaacataagaatctaagtccatataaaacatggctgctaaacaagtagaggttattcgcccagttgcaaactatcatccaagcctttggggagatcagtttctacactatgatgagcaagaggatgagcacgttgaggtagatcaacaaatcgaaattttgaaggaagaaacgcgaaaagaaatacttgcaagtttggatgatccaacaaaacatacaaatttgctgaagctgattgatgttatccaacgtctcggtatagcctattattttgaacatgagattacgcaagcattggaccatatttatagtgtatacggtgatgaatggaatggtggtcgtacttccctttggtttcggctcctccgacaacaaggcttttacgtttcatgtgatattttcaatatctacaagcttgataatggatctttcaaggattccttaaccaaggatattgaatgcatgcttgagttatatgaggcagcctatatgagggtgcaaggcgaaatcattctagatgaggctcttgagtttacaaaaactcatcttgaacacattgcaaaggatccacttcgttgcaacaacacgctctctagacacatacatgaagcactagagcggcctgtacagaaaaggttgccaagactagatgcaatacgatacatacctttctatgaacaacaagattctcacaacaagtccttactaagacttgcaaagttggggttcaaccggcttcaatccttgcataagaaggagcttagccaactttccaaatggtggaaagaatttgatgctccaaagaatctaccttacgtaagagatagattggttgaactctacttttggatactaggtgtctacttcgaacctcaatattctcgttcgagaatattcttgacaaaaacaattaaaatggcagcaattctagacgacacgtatgatatctatggtacttacgaagaacttgagatattcaccaaagccgttcaaaggtggtcaattacctgcatggatacgcttccagattacatgaaagtgatttataagagcctcttggatgtttatgaagaaatggaggaaatcatagaaaaggatggaaaagcatatcaagttcactatgcaaaagagtcgatgatagatttggttacaagttatatgaccgaagcaaaatggttacatgagggtcatgtgccaacatttgacgagcataactcagttacaaacataactggtggctataaaatgcttacagcatcaagctttgttggcatgcatggtgatatagttacacaagagtctttcaaatgggttctcaacaatcctccacttataaaagcttcatctgacattagtaggattatgaatgatatcgtcggtcacaaggaggagcaacaaagaaagcatattgcatctagtgtggaaatgtacatgaaagaatataatctcgcggaggaggacgtctatgattttctcaaagaaagagttgaagatgcatggaaagatataaaccgagaaacattaacatgtaaagacattcatatggctcttaagatgcctccgatcaacctggcacgcgtaatggatatgctatacaaaaacggtgataatttaaaaaatgttggacaagaaatccaagattatatgaaatcttgtttcattaatcctatgagtgtttgatttttggtccttcatgaccaattatcacgtctcatagatctgaaagatgttggttcgcacttttgaaagatgcaaggttatggtaccacactaaataagacctcaagtccactggagctataaaactatatatagctgatacgtattgtatttgtggattttaatttatgtattgtatttcatgtatttgtggattttaatctatgtattttatttcatgtattttgtggattttaatttatgttattgtatttcatgtttttcgatggaaaaaaaaaaaaaaaaa

SEQ ID NO: 668 - DNA, 1816 bp, Solidago canadensis
  germacrene D synthase
ataaaacatggctgctaaacaaggagaggttgttcgcccagatgcagactactcgtatcatccaagcctttggggagatcagtttctacactatgatgagcaagaggatgatcaagttgaggtagatcaacaaatcgaaattttgaaggaagaaacgagaagagaaatactctcaagtttggatgatccagcaaaacatacaaatttgctgaagctgattgatgttatccaacgtctcggtatagcctactattttgaacatgagattacgcaagcattggaccatatttataatgtatacggtgatgaatggaatggtggtagtacttccctttggtttcggctcctccgacaacaaggcttttatgtttcatgtgatattttcaatatctacaagcttgataatggatctttcaaggattccttaaccaaggatattgaatgcatgcttgagttatatgaggcagcctatatgagggtgcaaggcgaaatcattctagatgaggctcttgagtttacaaaaactcatcttgaacaaattgcaaaggatccccttcgttgcaacaacacgctctctagacacatatatgaagcgctgaagcggcctatacggaaaaggctaccaagagtggatgcattacaatacatgcctttctatgaacaacaagattcacacaacaagtccttactaagacttgcaaagttggggttcaaccggcttcaatccttgcataagaaggagcttagccaactttccaaatggtggaaagaatttgatgctccaaagaatctacgttacgtaagagatagattggttgaactctacttttgggtactaggtgtctacttcgaacctcaatattctcgttcaagaatattcttgacgaaggtaattaaaatggccacgattctagacgacacgtatgatatccatggcacttacgaagaacttgagatatttaccaaagccgttcaaaggtggtcaattacctgcatggatacgcttccagattacatgaaaatgatttataagagcctcttggatgtttatgaagaaatggaggaaatcatagagaaggatggaaaagcatatcaagttcactatgcaaaagactcgatgatagatttggttacaagttatatgaccgaagcgaaatggttacatgagggtcatgtgccaacatttgaggagtataactcaattacaaacttaactggtggctataaaatgcttacaacatcaagttttgttgacatgcctggtgatatagttacacaagagtctttcagatgggctcttaacaatcctccacttataaaagcttcagctgacgttagtaggattatggatgatatcgtcgggcacaaggaggagcaacaaagaaagcatcttccatctagggtggaaatgtacatgaaaaaatatcatcttgcggaggaggacgtctatgatttgctcaaacaaagagttgaagatgcatggaaagatctaaaccgagaaacattaacatgtaaagacattcatatggctcttaagatgcgtccgatcaacctggcacgcgtaatagatatgctatacaaaaacgatgataacttaaaaaatgttggacaagaaatccaagattatatcaaatcttgtttcattaatgctattagtgtttgatttttggtccttcatgaccaattatcacgtctcatagatctgaaagatgttggttcggtacttttgaaagatgcaaaggttatggtaccatactaaataagacctcaagtccatcggagctataaaaaaaaaaaaaaaaaaaaaaaaaaaaaa

SEQ ID NO: 669 - DNA, 2590 bp, Stevia rebaudiana
  (-)-copalyl diphosphate synthase
gcaaaacaaatccctctgatcctttcaccatgaagaccggcttcatctctcccgccaccgtcttccaccaccgtatttctccggcaaccaccttccgccaccacctttctccggcgaccaccaactccactggaattgtagctcttagagacatcaacttccggtgtaaagcggtatccaaagagtactctgatttactacaaaaagatgaggcttcatttaccaagtgggacgatgacaaagtgaaggaccatttggacacaaataagaatttgtatccaaacgatgagatcaaggagtttgttgagagcgtgaaagcaatgtttggttctatgaatgacggagaaataaatgtgtcagcgtatgatacggcttgggttgcactcgtgcaagatgttgatggaagtggttcccctcaatttccatcaagtttggagtggatcgcgaacaatcaactctcagatgggtcttggggcgatcatttgttattttcggctcatgataggatcattaacacgttggcatgtgttatagcgcttacttcttggaacgtccatccaagtaaatgtgaaaaaggactgaattttcttagagaaaacatatgtaaactcgaagacgagaacgcggaacatatgccaattggttttgaagtcacgttcccgtcgctaatagatatcgcaaagaagctaaatattgaagttcctgaggatactcctgccttaaaagaaatttatgcaagaagagacataaaactcacaaagataccaatggaagtattgcacaaagtgcccacaactttacttcatagtttggaaggaatgccagatttggaatgggaaaaacttctgaaattgcaatgcaaagatggatcatttctgttttctccatcatctactgcttttgcactcatgcaaacaaaagatgaaaagtgtcttcagtatttgacaaatattgttaccaaattcaatggtggagttccgaatgtgtacccggtggatctattcgaacatatttgggtagttgatcgacttcaacgacttgggattgctcgttatttcaaatcagagatcaaagattgcgttgaatatattaacaagtattggacaaagaatgggatttgttgggcaagaaacacgcacgtacaagatattgatgataccgcaatgggatttagggttttaagagcacatggttatgatgttactccagatgtatttcgacaatttgagaaggatggtaaattcgtatgtttcgctggacagtcaacacaagccgtcaccggaatgttcaatgtgtatagagcgtcacaaatgctctttcccggagaaagaattcttgaagatgcaaagaaattttcatataattatttgaaagaaaaacaatcgacaaatgagcttcttgataaatggatcatcgccaaagacttacctggagaggttggatatgcgctagacataccatggtatgcaagcttaccgcgactcgagacaagatattacttagagcaatacgggggcgaggatgatgtttggattggaaaaactctatacaggatgggatatgtgagcaataatacgtaccttgaaatggccaaattggactacaataactatgtggccgtgcttcaactcgaatggtacactatccagcaatggtatgttgatatcggtatcgaaaagtttgaaagtgacaatatcaaaagcgtattagtgtcgtattacttggctgcagccagcatattcgagccggaaaggtccaaggaacgaatcgcgtgggctaaaaccaccatattagttgacaagatcacctcaatttttgattcatcacaatcctcaaaagaggacataacagcctttatagacaaatttaggaacaaatcgtcttctaagaagcattcaataaatggagaaccatggcacgaggtgatggttgcactgaaaaagaccctacacggcttcgctttggatgcactcatgactcatagtcaagacatccacccgcaactccatcaagcttgggagatgtggttgacgaaattgcaagatggagtagatgtgacagcggaattaatggtacaaatgataaatatgacagctggtcgttgggtatccaaagaacttttaactcatcctcaataccaacgcctctcaaccgtcacaaatagtgtgtgtcacgatataactaagctccataacttcaaggagaattccacgacggtagactcgaaagttcaagaactagtgcaacttgtgtttagcgacacgcccgatgatcttgatcaggatatgaaacagacgtttctaaccgtcatgaaaaccttctactacaaggcgtggtgtgatccgaacacgataaatgaccatatctccaaggtgttcgagattgtaatatgaaaacagctaattataatatggttgagtaagtgttgaatggtaatttagatatcccaatgtccatcttgagttagattattcaatgttttaataaccgggtcgggttgtgtgaccgtcggaccagtttcaaaagcatatattagaattttgatgataggtgtgtaattgttaaatattaataaattgtgtctttaact

SEQ ID NO: 670 - DNA, 2792 bp, Stevia rebaudiana
  (-)-ent-kaurene synthase
cccactcatcctttatcaaccaataccatcgttctgccaccggaagactgatacgcgacggacctgacgacgcctttaatctctgttggaccacctaacaaaattccgaccatcagatctactccggtggacagtttcatttgcaatttagtaaatcagcaaactaaacatcaatgaatctttcactatgcatcgcgtcccctttgttaaccaaatcaaatcgacccgcggctctgtcagctattcatacagcatcaacttcacatggtggacaaactaatcccactaatctgatcattgatacaaccaaagaacggatccaaaaacagtttaaaaatgtagaaatttctgtttcttcatatgacacagcatgggtagccatggtcccttctccaaactcacccaaatcgccttgtttccctgagtgtctcaattggttaattaataatcagcttaatgatggttcatggggtcttgttaatcacactcataatcataatcacccgttgcttaaagattctctatcttcaacattagcatgtattgttgcattaaaaagatggaatgttggggaagatcaaataaataaaggtctaagttttattgagtcaaatcttgcttcagctactgaaaaaagtcaaccatctcccattggttttgacatcatatttcctggtttgcttgagtatgcgaaaaacttggacataaacctcctttcaaaacaaacagattttagtttgatgctacataagagggaattggagcaaaaaagatgccattcaaatgagatggatggatacttggcgtatatctctgaaggactcggtaatttatatgattggaatatggtgaagaaatatcagatgaaaaatggttctgttttcaactcaccatcagcaacagctgctgctttcattaatcatcaaaatcctggttgtcttaattatttaaattcacttttggacaagtttggtaatgcagtcccaacagtttatcctcatgatttatttatccgactttctatggttgacacaattgaaagattaggaatttcacaccatttcagagtggaaattaaaaatgttttagatgaaacatacagatgttgggtggaacgagatgagcaaatattcatggatgttgtaacatgtgctttagcctttcggttattaaggatcaatgggtatgaagtttccccagatccattggctgaaattactaatgaattagctttgaaagacgaatatgcagctcttgaaacatatcatgcgtcacatatattataccaagaggatttatcttctggaaaacaaatcttgaagtcagctgatttcctcaaagagataatatccactgattcaaacaggctttctaaattaattcacaaagaggtggaaaatgctcttaagttccctatcaataccggtttagaacgcataaacactagacgaaatatacagctttacaatgtagacaatacaagaattctgaaaactacatatcactcatcaaatattagtaacactgattacctaaggttggctgttgaagatttctacacctgccaatctatttatcgtgaagaattaaaaggtcttgaaaggtgggtggtagagaataagttggaccagctcaagtttgctaggcaaaagaccgcctactgttatttctctgttgctgcaacactttcgtctcccgaattatcagatgcgcgtatttcatgggccaaaaatggcatattaactacagtagttgatgacttttttgatatcggtggtacaatcgatgaattgaccaacctgattcaatgtgttgaaaaatggaatgtagatgtcgacaaggattgttgttcagagcatgttcggattttatttttagcattaaaagatgcaatctgttggattggagatgaagcttttaaatggcaagcgcgcgatgtaactagccatgttattcaaacttggttggaactaatgaatagtatgttgagagaagctatatggacaagagatgcttatgtgccaacattaaatgaatatatggaaaacgcttacgtgtcatttgcattaggcccgattgtcaagccggctatttactttgtggggcccaaattatcagaggagattgttgaaagctctgaatatcataatctatttaagctaatgagcacgcagggtcgacttctaaacgatatccatagcttcaagagggaatttaaggaaggcaaattaaacgcggtagcattgcatttgagtaacggagaaagtgggaaagtggaagaagaggttgtggaggagatgatgatgatgattaaaaacaagaggaaagaattaatgaaattaatttttgaagaaaatggtagcattgttcctagagcttgtaaagatgcattttggaacatgtgtcacgtgttgaattttttttacgcaaacgatgacgggtttactggaaacacgattcttgatactgtgaaggacatcatttacaacccgttggtgcttgtgaatgaaaatgaagaacaaaggtaattggcctttaaaagatgataataatatcatgctcttgacgggggtactgttgtagttgtataataaaggttgtagttgtataataaaggtaataggtaatcaatagaaagcttaagttattaagtttttccctcgtgtcacacacggtgaggttcttgttaaagcagtttattttatgtttagtacgacacttggtggttgttcgttgtttattctctaagaggctttcactttgttcttaaaaaaaaaaaaaaaaaaaaaaaa

SEQ ID NO: 671 - DNA, 3117 bp, Stevia rebaudiana
  kaurene synthase
atttcttttgctctgattgaacacacgattatctgtatttatgaggattgtagcatattgtttgattttttatgattattttacacttattctctgtcatctccgagtctatttggtctgacaagcaatacaatatcctcttagattcactctacataggatttaggatgcattgttattatcctaaaatcatcttcattttgatccattgcactgcctgctccgtaagcttcttatgattcggataattccggtagagaataaagttcggagtatgcatcattgaagttaatattctggattgatgttcgttaggaattggtacagtagaaaattagctagtttgcttgatttgacctagaatatagcttcagaaatttgttaatctgtgagcaatgattcagatgttgataacttttggggcaacttcatgttaaaaaacttatatattaaaatgttttcaagttggtgttgcagtaaatcagcaaactaaacatcaatgaatctttcactatgcattgcgtcccctttgttaaccaaatcaagtcgacccacggctctgtcagctattcatacagcatcaacttcacatggtggacaaactaatcccactaatctgatcattgatacaaccaaagaacggatccaaaaactgtttaaaaatgtagaaatttctgtttcttcatatgacacagcatgggtagccatggtcccttctccaaactcacccaaatcgccttgtttccctgagtgtctcaattggttaattaataatcagcttaatgatggttcatggggtcttgttaatcacactcataatcataatcacccgttgcttaaagattctctatcttcaacattagcatgtattgttgcattaaaaagatggaatgttggggaagatcaaataaataaaggtctaagttttattgagtcaaatcttgcttcagcaactgacaaaagtcaaccatctcccattggttttgatatcatatttcctggtttgcttgagtatgcgaaaaacttggacataaacctcctttcaaaacaaacagattttagtttgatgctacataagagggaattggagcaaaaaagatgccattcaaatgagattgatggatacttggcgtatatctctgaaggactcggtaatttatatgattggaatatggtgaagaaatatcagatgaaaaatggttctgttttcaactcaccatcagcaacagcagctgctttcattaatcatcaaaatcccggttgtcttaattatttaaattcacttttggacaagtttggtaatgcagtcccaacagtttatcctcttgatttatatatccggctttctatggttgacacaattgaaagattaggaatttcacaccatttcagagtggaaattaaaaatgttttagatgaaacatacagatgttgggtggaacgagatgagcaaatattcatggatgttgtaacatgtgctttagcctttcggttattaaggatccacgggtataaagtctccccagatcaattggctgaaattactaatgaattagctttcaaagacgaatacgcagctcttgaaacatatcatgcatcacagatattataccaagaggatttatcttctggaaaacaaatcttgaagtcagctgatttcctcaaagggatattatccactgattcaaacaggctttctaaattaattcacaaagaggtggaaaatgctcttaagttccctatcaataccggtttagaacgcataaacactagacgaaatatacagctttacaatgtagacaatacaagaattctgaaaactacatatcactcatcaaatattagtaacacttattacctaaggttggctgttgaagatttctacacctgccaatctatttatcgtgaagaattaaaaggtcttgaaaggtgggtggtacagaataagttggaccagctcaagtttgctaggcaaaagaccgcctactgttatttctctgttgctgcaacactttcgtctcccgaattatcagatgcgcgtatttcatgggccaaaaatggcatattaactacagtagttgatgacttttttgatatcggtggtacaatcgatgaattgaccaacctgattcaatgtgttgaaaaatggaatgtagatgtcgacaaggattgttgttcagagcatgttcggattttatttttagcattaaaagatgcaatctgttggattggagatgaagcttttaaatggcaagcgcgcgatgtaactagccatgttattcaaacttggttggaactaatgaatagtatgttgagagaagctatatggacaagagatgcttatgtgccaacattaaatgaatatatggaaaacgcttacgtgtcatttgcattaggcccgattgtcaagccggctatttactttgtggggcccaaattatcagaggagattgttgaaagctctgaatatcataatctatttaagctaatgagcacgcagggtcgacttctaaacgatatccatagcttcaagagggaatttaaggaaggcaaattaaacgcggtagcattgcatttgagtaacggagaaagtgggaaagtggaagaagaggttgtggaggagatgatgatgatgattaaaaacaagaggaaagaattaatgaaattaatttttgaagaaaatggtagcattgttcctagagcttgtaaagatgcattttggaacatgtgtcacgtgttgaattttttttacgcaaacgatgacgggtttactggaaacacgattcttgatactgtgaaggacatcatttacaacccgttggtgcttgtgaatgaaaatgaagaacaaaggtaattggcctttaaaagatgataataatatcatgctcttgacgggggtactgttgtagttgtataataaaggttgtagttgtataataaaggtaataggtaatcaatagaaagcttaagttattaagtttttccctcgtgtcacacacggtgaggttcttgttaaagcagtttattttatgtttagtacgacacttggtggttgttcgttgtttattctctaagaggctttcactttgttcttaataagaagtttttattgtgttg

SEQ ID NO: 672 - DNA, 2706 bp, Taxus wallilchiana
  Taxadiene synthase
gggtaccatggctcagctctcatttaatgcagcgctgaagatgaatgcattggggaacaaggcaatccacgatccaacgaattgcagagccaaatctgagggccaaatgatgtgggtttgctccaaatcagggcgaaccagagtaaaaatgtcgagaggaagtggtggtcctggtcctgtcgtaatgatgagcagcagcactggcactagcaaggtggtttccgagacttccagtaccattgtggatgatatccctcgactctccgccaattatcatggcgatctgtggcaccacaatgttatacaaactctggagacaccatttcgtgagagttctacttaccaagaacgggcagatgagctggttgtgaaaattaaagatatgttcaatgcgctcggagacggagatatcagtccgtctgcatacgacactgcgtgggtggcgagggtggcgaccatttcctctgatggatctgagaagccacggtttcctcaggctctcaactgggttttcaacaaccagctccaggatggatcgtggggtatcgaatcgcactttagtttatgcgatcgattgcttaacacgaccaattctgttatcgccctctcggtttggaaaacagggcacagccaagtagaacaaggtactgagtttattgcagagaatctaagattactcaatgaggaagatgagttgtccccggatttcgaaataatctttcctgctctgctgcaaaaggcaaaagcgttggggatcaatcttccttacgatcttccatttatcaaatatttgtcgacaacacgggaagccaggcttacagatgtttctgcggcagcagacaatattccagccaacatgttgaatgcgttggagggtcttgaggaagttatggactggaagaagattatgaggtttcaaagtaaagatggatctttcctgagctcccctgcttccactgcctgtgtactgatgaatacaggggacgaaaaatgtttcacttttctcaacaatctgctggtcaaattcggcggctgcgtgccctgtatgtattccatcgatctgctggaacgcctttcgctggttgataacattgagcatctcggaatcggtcgccatttcaaacaagaaatcaaagtagctcttgattatgtctacagacattggagtgaaaggggcatcggttggggcagagacagcctcgttccagatctcaacacaacagccctcggcctgcgaactcttcgcacgcacggatacgatgtttcttcagatgttttgaataatttcaaagatgaaaacgggcggttcttctcctctgcgggccaaacccatgtggaattgagaagcgtggtgattcttttcagagcttccgaccttgcatttcctgacgaaggagctatggacgatgctagaaaatttgcagaaccatatcttagagacgcacttgcaacaaaaatctcaaccaatacaaaactattcaaagagattgagtacgtggtggagtacccttggcacatgagtatcccacgctcagaagccagaagttatattgattcgtatgatgacgattatgtatgggagaggaagactctatatagaatgccatctttgagtaattcaaaatgtttagaattggcaaaattggacttcaatatcgtacaatctttgcatcaagaggagttgaagcttctaacaagatggtggaaggaatccggcatggcagatataaatttcactcgacaccgagtggcggaggtttatttttcatcagctacatttgaacccgaatattctgccactagaattgccttcacaaaaattggttgtttacaagtcctttttgatgatatggctgacatctttgcaacactagatgaattgaaaagtttcactgagggagtaaagagatgggatacatctttgctacatgagattccagagtgtatgcaaacttgctttaaagtttggttcaaattaattgaagaagtaaataatgatgtggttaaggtacaaggacgtgacatgctcgctcacataagaaaaccctgggagttgtacttcaattgttatgtacaagaaagggagtggcttgacgctgggtatataccaacttttgaagagtacttaaagacttatgctatatcagtaggccttggaccgtgtaccctacaaccaatactactaatgggtgagcttgtgaaagatgatgttgttgagaaagtgcactatccctcaaatatgtttgagcttgtatccttgagttggcgactaacaaacgacaccaaaacatatcaggctgaaaaggctcgaggacaacaagcctcaggcatagcatgctatatgaaggataatctaggagcaactgaggaagatgccatcaagcacatatgtcgtgttgttgaccgggccttgaaagaagcaagctttgaatatttcaaaccatccaatgatatcccaatgggttgcaagtcctttatttttaaccttagattgtgtgtccaaatcttttacaagtttatagatgggtacggaatcgccaatgaggagattaaggattatataagaaaagtttatattgatccaattcaagtatgatatatcatgtaaaacctttttttcataataaattgaattattattgtattggcaaaaaaaaaaaaaaaaaaaaaaaaaaaaaaaaaaaaaaaaaaaaaaaaaaaaaaaaa

SEQ ID NO: 673 - DNA, 1674 bp, Vitis vinifera
  (-)-germacrene D synthase
atgtctgttcagtcttcaggggtacttcttgctccatctaaaaacctcagccctgaggttggccggcgctgtgcaaattttcatcccagcatttggggggatcatttcctttcttatgcttctgaattcacaaacactgacgatcatttgaagcaacatgtccaacagctgaaagaagaagtgaggaagatgctaatggctgctgatgatgattctgcgcaaaagttgctcttgattgatgcaatccaacggctgggagttgcttaccattttgagagtgagattgatgaagtattaaaacacatgttcgatggttccgttgtctctgctgaagaagatgtttatactgcttctctccgatttcggttactaagacaacaagggtaccatgtctcatgtgatttattcaacaatttcaaggataatgaaggaaacttcaaggaatccctcagcagcgatgtgcggggaatgttaagcttgtatgaagccacacatttcagggtgcatggagaagatatattagatgaagcacttgctttcactaccactcaccttcagtccgccacaaagcactcttcaaatcctcttgctgaacaagtagttcatgccctgaagcagcccatccgaaaggggttacctaggctagaggccaggcattatttttctgtgtaccaagcagatgattctcataacaaagctctgctgaagctagcaaagttggatttcaacctattacagaaattacaccagaaggagctaagtgacatttccgcgtggtggaaagatttagactttgcacacaagcttccttttgcaagagatcgggtggtggaatgctacttttggatattgggggtgtactttgagccccagtttttcttcgctagaaggattctcactaaagtaatagccatgacctctattattgatgacatctatgacgtgtatggtacacttgaagaactcgagctcttcaccgaagcagttgagaggtgggatatcagtgccatagatcaactgccagagtacatgagagtgtgttatcaagcactcttatatgtgtacagtgaaattgaggaagaaatggccaaggaaggaagatcgtatcggctctactatgcaaaagaagcaatgaaaaatcaagtaagagcatactatgaggaagccaaatggcttcaagtgcaacaaattccaaccatggaggagtacatgcctgtggcgttagttacctctgcatactcaatgctggcgaccacatcgtttgttggaatgggagatgctgtgacaaaagaaagcttcgattggattttcagtaagcctaagattgtaagggcttcagccatagtttgcaggctcatggatgatatggttttccacaagtttgagcagaagagaggacatgttgcctcagctgttgaatgttacatgaagcaacatggtgcgtcggagcaggaaacgcccaacgaatttccccaaccagttagagaagcatggaaggatatcaatgaagagtgcctcatcccaacagctgtcccaatgcccatcctcatgcgagttctaaatctcgcacgtgttatagatgttatatacaagaatgaagatggctatactcattttggggctgttttaaaggatttcgtaacttccatgctaattgatcctgtgccaatatga

SEQ ID NO: 674 - DNA, 1671 bp, Vitis vinifera
  (+)-valencene synthase
atgtctactcaagtctcagcatcttctctagcccagattccccaacccaaaaatcgtcctgtggcaaactttcaccccaacatttggggtgaccaatttatcacctacactcctgaagacaaggttactcgtgcctgcaaagaggagcagattgaggatctgaaaaaggaagtgaaaaggaaattaacggctgctgctgttgctaacccttcccaattgctgaacttcattgatgcagtgcaacgtcttggggtggcataccactttgagcaagagatagaagaagcattacaacatatttgtaatagttttcatgactgcaatgatatggatggtgatctctacaatattgctcttggatttcgactactaaggcaacaagggtacactatttcatgtgatatattcaacaagtttacggatgaacgaggtagattcaaggaagctttgatcagcgatgtaagaggcatgctaggcttgtatgaagctgcacatctgagggttcatggagaggacatacttgcaaaagcacttgctttcaccaccactcatctcaaggccatggtagaaagtttaggatatcatcttgcagaacaagttgctcatgccctgaaccggcccattagaaaaggtttggagaggctagaggcaagatggtatatatctgtctaccaagatgaagctttccatgataaaactttactagagctagcaaaattagatttcaatctagtgcagtcactgcacaaggaagagctaagcaatcttgcaaggtggtggaaagaattagactttgctacaaagttaccttttgcacgagacagattggttgaaggctacttttggatgcatggggtgtattttgagccccaatacttacggggtagacgaattctaaccaaagtaattgccatgacatccattctagatgatatccatgatgcatatggcacacctgaagaactcaagctcttcatagaagccattgagagatgggatattaacagcataaatcagcttccagaatacatgaaactctgctatgtggcactcttagatgtgtacaaagaaatcgaggaagagatggagaaagaaggaaaccaatatcgggttcactatgccaaagaagtaatgaagaatcaagttcgagcttactttgccgaggccaaatggttacatgaagaacacgtaccagcatttgaagagtacatgcgtgttgcactagcaagctctggatactgcctgcttgcaaccacgtcctttgtgggaatgggagaaatagcaacaaaggaggcctttgattgggtgaccagcgatcctaagattatgtcatcttcaaatttcattacgaggctcatggatgacatcaaatcacataagtttgagcaaaagagagggcatgtggcctcagctgttgaatgttacatgaagcaatatggtgtctctgaggaacaagtatacagtgaatttcaaaagcaaattgagaatgcatggctggatattaaccaggaatgcctcaaacctactgctgtttcaatgcctctccttgctcgtcttctcaatcttacacgaaccatggatgtcatttacaaagagcaagattcgtacacacatgttgggaaagtgatgagggataacattgcgtctgtcttcatcaacgctgtaatataa

SEQ ID NO: 675 - DNA, 1671 bp, Vitis vinifera
  (+)-valencene synthase
atgtctactcaagtctcagcatcttctctagcccagattccccaacccaaaaatcgtcctgtggcaaactttcaccccaacatttggggtgaccaatttatcacctacactcctgaagacaaggttactcgtgcctgcaaagaggagcagattgaggatctgaaaaaggaagtgaaaaggaaattaacggctgctgctgttgctaacccttcccaattgctgaacttcattgatgcagtgcaacgtcttggggtggcataccactttgagcaagagatagaagaagcattacaacatatttgtaatagttttcatgactgcaatgatatggatggtgatctctacaatattgctcttggatttcgactactaaggcaacaagggtacactatttcatgtgatatattcaacaagtttacggatgaacgaggtagattcaaggaagctttgatcagcgatgtaagaggcatgctaggcttgtatgaagctgcacatctgagggttcatggagaggacatacttgcaaaagcacttgctttcaccaccactcatctcaaggccatggtagaaagtttaggatatcatcttgcagaacaagttgctcatgccctgaaccggcccattagaaaaggtttggagaggctagaggcaagatggtatatatctgtctaccaagatgaagctttccatgataaaactttactagagctagcaaaattagatttcaatctagtgcagtcactgcacaaggaagagctaagcaatcttgcaaggtggtggaaagaattagactttgctacaaagttaccttttgcacgagacagattggttgaaggctacttttggatgcatggggtgtattttgagccccaatacttacggggtagacgaattctaaccaaagtaattgccatgacatccattctagatgatatccatgatgcatatggcacacctgaagaactcaagctcttcatagaagccattgagagatgggatattaacagcataaatcagcttccagaatacatgaaactctgctatgtggcgctcttagatgtgtacaaagaaatcgaggaagagatggagaaagaaggaaaccaatatcgggttcactatgccaaagaagtaatgaagaatcaagttcgagcttactttgccgaggccaaatggttacatgaagaacacgtaccagcatttgaagagtacatgcgtgttgcactagcaagctctggatactgcctgcttgcaaccacgtcctttgtgggaatgggagaaatagcaacaaaggaggcctttgattgggtgaccagcgatcctaagattatgtcatcttcaaacttcattacgaggctcatggatgacatcaaatcacataagtttgagcaaaagagagggcatgtgacctcagctgttgaatgttacatgaagcaatatggtgtctctgaggaacaagtatacagtgaatttcaaaagcaaattgagaatgcatggctggatattaaccaggaatgcctcaaacctactgctgtttcaatgcctctccttgctcgtcttctcaattttacacgaaccatggatgtcatttacaaagagcaagattcgtacacacatgttgggaaagtgatgagggataacattgcgtctgttttcatcaacgctgtaatataa

SEQ ID NO: 676 - DNA, 1644 bp, Zea diploperennis
  (E)-beta-caryophyllene synthase
atggcagctgatgaggcaagatccgtcagcaggctccatagtgaggaggacatgcatggcaagcaccactccactctatggggtgacttcttccttcaccatgtcccatgtcgtccaggacagtatttgattatgaaggataaggtcaaaataatgaaggaggaggtgaagaaaatgttactggatgttggatcctctgatttgtctcataagttagactgcattaatacactagaacggcttggattggattaccactataccaaggagattgatgaattaatgtgcaatgtcttcgaagctagggatcaagatcttgatcttactacaacatcacagcttttctatttgcttaggaagcatggatatcatgtttcttctgatgtatttttgaagttcagagatgataaaggagatatcgtaacagatgatgcaaggtgtttactaagaatgtacgaagcggcacatgttagagtgaacggtgaagaaattcttgacaatattctcattcacaccaagagacaacttcaatgtattgtagacgatctcgaaccaacactgcaagaagaagtgagatatgcattggagacacctcttttcagaagactcaacagagtacaggccaggcaattcatctcaacatacgagaaaagcactacgcgtaacaatatgctcctggagttctcaaagttagacttcaacatcttgctcaccctatactgtgaggagctaaaagatcttacgctgtggtggaaagagttccaagcacaggctaacacagcaatctatgcacgagataggatggtggagatgcatttctggatgatgggagtcttttttgagccccaatactcctattcacgaaagatgctcacacaattgtttatgatcgtgtctgtactcgatgacttgtatgacagccattgcaccacagaggaaggcaacaccttcactgcagcattacaaaggtgggatgaagaaggcgtggaacaatgcccaacatacttgaggactttgtatacaaatatacgtgccaccgtaaaagccatcgaggaggacttgaatcttcaaaacaacaaacatgcaaagttggtaaaaggactgataatcgacatggccatgtgctataatgccgagacagaatggcgtgacaagaaatatgtgccagccaccgttgatgaacatctgaaaatttcagcacgcagcagtggctgtatgcacttggtgagccaggggttcatttcgatgggagatgtggcaactagcgaggccctcgagtgggcctctacctatcccaaaatcgttcgagctgtctgtatcattgcacgcctcgctaacgatataatgtcgtacaagcgagaagcatcaaacaatactatggtgtctacagtgcaaacttgtgcaaaagaatacggcaccaccacagtagaacaggccatagaaaagatcagagagctgatcgaggaagcgtggatggacatcacccatgagtgcctcagacagccacagccgaaggctcttctagagagggcggtcaacctggctcgtacaatggattttctgtacaaagatgtggatggatacacagattcacggagtatcaaaggcatattggattcattgtatgtgcatctaatagactaa

SEQ ID NO: 677 - DNA, 1644 bp, Zea luxurians
  (E)-beta-caryophyllene synthase
atggcagctgatgaggcaagatccgtcagcaggctccacggtgaggaggacatgcatggcaagcaccactccactctatggggtgacttcttccttcaccatgtcccatgtcgtccaggacagtatttgattatgaaggataacgtcgaaataatgaaggaggaggtgaagaaaatgttactggatgttggatcctctgatttgtctcataagttagactgcattgatacactaggacggcttggattggattaccactataccaaggagattgatgaattaatgtgcaatgtcttcgaagctatggatcaagatcttgatcttactacaacatcgcagcttttctatttgcttaggaagcatggatatcatatttcttctgatgtatttttgaagttcagagatgataaaggagatattgtaacaaatgatgcaaggtgtttactaaggatgtacgaagcggcacatgttagagtgaacggtgaagaaatacttgacaatattctcattcacaccaagagacagcttcaatgtattgtagacgatctcgaaccaacactgcaagaagaagtgagatatgcattggagacacctcttttcagaagactcaacagagtacaggccaggcaattcatctcaacatacgagaaaagcactacgcgtaacaatatgctcctggagttctcaaagttagacttcaacatcttgctcaccctatactgtgaggagctaaaagatcttacgctgtggtggaaagagttccaagcacaggctaacatgacaatctatgcacgagataggatggtggagatgcatttctggatgatgggagtcttctttgagccccaatactcctattcacgaaagatgctcacacgattgtttatgatcgtgtctgtactcgatgacttgtatgacagccattgcaccacagaggaaggcaacgccttcactgcagcattacaaaggtgggatgaagaaggcgtggagcaatgcccaacatacttgaggactttgtatacaaatatacgtgccaccgtaaaagccatcgaggaggacttgaatcttcaaaacaacaaacatgcaaagttggtaaaaggactgataatcgacatggccatgtgctataatgccgagacagaatggcgtgacaagaaatatgtgccagccaccgttgatgaacatctgaaaatttcagcacgcagcagtggctgtatgcacttggtaagccaggggttcatttcgatgggagatgtggcaactagcgaggccctcgagtgggcctctacctatcccaaaatcgttcgagctgtctgtatcattgcacgcctcgctaatgatataatgtcgtacaagcgagaagcatcaaacaatactatggtgtctacagtgcaaacttgtgcaaaagaatacggcaccaccacagtagaacaggccatagaaaagatcagagagctgatcgaggaagcgtggatggacatcacccatgagtgcctcagacagccacagccgaaggctcttctagagagggcggtcaacctggctcgtacaatggattttctgtacaaagatgtggatggatacacagattcacggagtatcaaaggcatattggattcattgtatgtgcatctaatagactaa

SEQ ID NO: 678 - DNA, 1644 bp, Zea mays
  (E)-beta-caryophyllene synthase
atggcagctgatgaggcaagatccgtcagcaggctccacagtgaggaggacatgcatggcaagcaccactccactctatggggtgacttcttccttcaccatgtcccatgtcgtccaggacaatattcaattatgaaggataacgtcaaaataatgaaggaggaggtgaagaaaatgttactggatgttggatcctctgatttgtctcataagttagaatgcattgatacactagaacggcttggattggattaccactataccaaggagattgatgaattaatgtgcaatgtcttcgaagctagggatcaagatcttgatcttactacaacatcacaacttttctatttgcttaggaagcatggatatcatgtttcttctgatgtatttttgaagttcggagatgataaaggagatatcgtaacagatgatgcaaggtgtttactgagaatgtacgaagcggcacatgttagagtgaatggtgaagaaatacttgacaatattctcattcacaccaagagacagcttcaatgtattgtagacgatctcgaaccaacactgcaagaagaagtgagatatgcattggagacacctcttttcagaagactcaacagagtacaggccaggcaattcatctcaacatacgagaaaagcactatgcgtaacaatatgctcctggagttctcaaagttagacttcaacatcttgctcaccctatactgtgaggagctaaaagatcttacgatgtggtggaaagagttccaagcacaggctaacacgacaatctatgcacgagataggatggtggagatgcatttctggatgatgggagtcttctttgagccccaatactcctattcacgaaagatgctcacacagttgtttatgatcgtgtctgtactcgatgacttgtatgacagccattgcaccacagaggaaggcaatgccttcactgcagcattacaaaggtgggacgaagaaggcgtggagcaatgtccaacatacttgaggactttgtatacaaatatacgtgccaccgtaaaagccatcgaggaagacttgaatcttcaaaacaacaaacatgcaaagttggtaaaaggactgataatcgacatggccatgtgctataatgccgagacagaatggcgtgacaagaaatatgtgccagccaccgttgatgaacatctgaaaatttcagcacgcagcagtggttgtatgcacttggtgagccaggggttcatttcgatgggagatgtggcaactagcgaggccctcgagtgggcctctacctatcccaaaatcgttcgagctgtctgtatcattgcacgcctcgctaacgatataatgtcgtacaagcgagaagcatcaaacaatactatggtgtctacagtgcaaacttgtgcaaaggaatacggcaccaccacagtagaacaggccatagaaaagatcagagagttgatcgaggaagcgtggatggacatcacccatgagtgcctcagacagccacagccgatggctcttctcgagagggcggtcaacctggctcgtacaatggattttctgtacaaagatgtggatggatacacagattcatggagtatcaaaggcatattggattcattgtatgtgcatctaatagactaa

SEQ ID NO: 679 - DNA, 1647 bp, Zea mays
  (-)-beta-macrocarpene synthase
atggctgccccaacactaactgcagatggtcctcgcctcggccagcaggagatgaagaagatgtctccctccttccatccaactctgtggggagatttctttctttcttacgaggctccgaccgaggcacaggaagctcaaatgagagaaaaggctgcagtgctaaaggaagaagtgagaaacatgattaaaggttcacatgatgtgccagaaatagtggaccttattatcaccctgcagcgactaaatctggactaccactacgaggatgagataaatgaaaagttgactgttgtttacaaatccaattatgatggtggtaatttggacttagtttcacgtcgattctatcttctgcgtaaatgtggctacgatgtttcatctgatgtattcctaaaattcaaagaccaacttgggaattttgttgaggctgataccaggagcttgttaagcttatacaatgcagcattcctgaggattcatggagagacagtgcttgacgaggcaatttcttttactatgagagttcttcaagatagattagaacatttggaatcgccattagcagaggaagtgtcttctgctcttgacacaccactttttcgaagggttggaactttggaaatgaaggattacattcctatctacgaaaaggacgctaaacaaaataaatcaatattagagtttgcgaaactaaacttcaaccttttacaacttcgttattcatcagagctaaaagagtgcacaacctggtggaaagaacttcgcgtcgaatcaaacttgagtttcgtcagggataggatagtagaggtgtacttttggatgagtgggggatgctatgatcctcaatattctcattctcgaattatacttacaaagatagttgctttcatcacgattctagatgatacccttgactcacatgctacttcttgtgagagtatgcaacttgcagaagcaatcgaaaggtgggatgaaagtgcagtctctctactcccagaatacatgaaggatttctacatgtatttgttgaagacattttcatcgtttgagaatgagttaggaccagacaagagctaccgagtgttctacttaaaagaagcggtgaaggaattagttcgggaatataccaaggaaataaaatggcgtgatgaggattatgtgcccaaaacattgaaagagcaccttaaagtttcactcataagcattggaggcactctggtgctatgttctgcgtttgttggaatgggtgatgtagtaacaaagaagatcatgaaatgggttatgagtgatgctgaacttgttaagtcttttggtatatttgtacggctctccaatgatattgtatcaaccaagcgtgaacaaagagagaagcattgtgtctccactgttcagtgttacatgaagcagcatgaaataacaatggatgaagcgtgtgagcagataaaagaacttacagaagattcatggaagttcatgattgaacaaggccttgcactaaaagaatacccgataattgtgccacgaacggtactagagtttgcacgaactgtagactacatgtacaaggaagctgataagtacactgtctcacatacaatcaaagacatgttaacgtcgctttatgtgaagccggtactcatgtga

SEQ ID NO: 680 - DNA, 1742 bp, Zea mays
  (-)-beta-macrocarpene synthase
cgactggagcacgaggacactgacatggactgaaggagtagaaaatcccatatctcactaccaaaagcatccgatcccacacatctgctaaaaggatggctgccccaacactaactgcagatggtcctcgcctcggccagcaggagatgaagaagatgtctccctccttccatccaactctgtggggagatttctttctttcttacgaggctccgaccgaggcacaggaggctcaaatgagagaaaaggctgcagtgctaaaggaagaagtgagaaacatgattaaaggttcacatgatgtgccagaaatagtggaccttattatcaccctgcagcgactaaatctggactaccactacgaggatgagataaatgaaaagttgactgttgtttacaaatccaattatgatggtggtaatttggacttagtttcacgtcgattctatcttctgcgtaaatgtggctacgatgtttcatctgatgtattcctaaaattcaaagaccaacttgggaattttgttgaggctgataccaggagcttgttaagcttatacaatgcagcattcctgaggattcatggagagacagtgcttgacgaggcaatttcttttactatgagagttcttcaagatagattagaacatttggaatcgccattagcagaggaagtgtcttctgctcttgacgcaccactttttcgaagggttggaactttggaaatgaaggattacattcctatctacgaaaaggacgctaaacaaaataaatcaatattagagtttgcgaaactaaacttcaaccttttacaacttcgttattcatcagagctaaaagagtgcacaacctggtggaaagaacttcgcgtcgaatcaaacttgagtttcgtcagggataggatagtagaggtgtacttttggatgagtgggggatgctatgatcctcaatattctcattctcgaattatacttacaaagatagttgctttcatcacgattctagatgatacccttgactcacatgctacttcttgtgagagtatgcaacttgcagaagcaatcgaaaggtgggatgaaagtgcagtctctctactcccagaatacatgaaggatttctacatgtatttgttgaagacattttcatcgtttgagaatgagttaggaccagacaagagctaccgagtgttctacttaaaagaagcggtgaaggaattagttcgggaatataccaaggaaataaaatggcgtgatgaggattatgtgcccaaaacattgaaagagcaccttaaagtttcactcataagcattggaggcactctggtgctatgttctgcgtttgttggaatgggtgatgtagtaacaaagaagatcatgaaatgggttatgagtgatgctgaacttgttaagtcttttggtatatttgtacggctctccaatgatattgtatcaaccaagcgtgaacaaagagagaagcattgtgtctccactgttcagtgttacatgaagcagcatgaaataacaatggatgaagcatgtgagcagataaaagaacttacagaagattcatggaagttcatgattgaacaaggccttgcactaaaagaatacccgataattgtgccacgaacggtactagagtttgcacgaactgtagactacatgtacaaggaagctgataagtacactgtctcacatacaatcaaagacatgttaacgtcgctttatgtgaagccggtactcatgtga

SEQ ID NO: 681 - DNA, 1647 bp, Zea mays
  (-)-beta-macrocarpene synthase
atggctgccccaacactaactacagatggtcctcgcctcggccagcaggagatgaagaagatgtctccctccttccatccaactctgtggggagatttctttctttcttacgaggcgccgaccgaggcacaggaagctgaaatgcgacaaagggctgaagtgctgagggaagaagtgagaaacatgattaaaggttcacatgatgtgccagaaatagtggaccttattatcaccctgcagcgactaaatctggactaccactacgaggatgagataaatgaaaagttggctgttgtttacaactccaattatgatggtggtaatttggacttagtttcacgccgattctatcttctgcgtaaatgtggctatcatgtttcatccgatgtatttctaaatttcaaagaccaatatggaaattttattgaggtagataccaggagcttgttaagcttatacaatgcagcatacctgaggattcatggagagacagtgcttgatgaggcaatttcttttactacgagatgccttcaagatagattagaacatttggaatcaccaatagcagaggaagtgtcgtctgcccttgataccccactttttagaagggttggaactttggaaatgaaggattacattcctatctacgaaaaggacgctaaacaaaacaaatcaatattagagtttgcgaaactgaacttcaaccttctacagcttctttattcatcagagctcaaagagtgcacaacctggtggaaagaactccgcgtcgaatcaaacttgagttttgtgagggatagaatagtagaggtgtacttttggatgagtgggggatgctatgatcctcaatattctcattctcgaattatacttacaaagattgttgctttcatcacgattctagatgatacccttgactcacatgctaattcttatgagagtatgcaacttgcagaagcagtcgaaaggtgggatgaaagtgcagtctcactactcccagaatacatgaaggatttctacatgtatttgttgaagacattttcatcgtttgagaatgagttaggaccagacaagagctaccgagtgttctacttaaaagaagcggtgaaggaattagttcgggaatataccaaggaaataaaatggcgtgatgaggattatgtccccaaaacattgaaagaacacctaaaagtttcactcataagcattggaggtacactggtgctgtgttccgcgtttgttggaatgggtgatgtagtaacaaagaagatcatggaatgggttatgagtgatgctgaacttgttaagtcttttggtatatttgtacggctctccaatgatattgtatcaaccaagcgtgaacaaagagagaagcattgtgtctccactgttcagtgttacatgaagcagcatgaactaacaatggatgaagcatgtgagcagataaaagaacttacagaagattcatggaagttcatgattgaacaaggccttgcactaaaagaatacccgataattgtgccacgaaccgtactagagtttgcacgaactgtagactacatgtacaaggaagctgataagtacactgtctcccatacaatcaaagacatgttaacatcgctttatgtgaagccggtactcatgtga

SEQ ID NO: 682 - DNA, 1644 bp, Zea mays
  (E)-beta-caryophyllene synthase
atggcagctgatgaggcaagatccgtcagcaggctccacagtgaggaggacatgcatgggaagcaccactccactctatggggtgacttcttccttcaccatgtcccatgtcgtccaggacagtatttgattatgaaggataacgtcgaaataatgaaggaggaggtgaagaaaatgttactggatgttggatcctctgatttgtctcataagttagactgcattgatacactagaacggcttggactggattaccactataccaaggagattgatgaattaatgtgcaatgtcttcgaagctagggatcaagatcttgatcttactacaacatcacagcttttctatttgcttaggaagcatggatatcatatttcttctgatgtatttttgaagttcagagatgataaaggagatatcgtaacaaatgatgcaaggtgtttactgaggatgtacgaagcggcacatgttagagtgaacggtgaagaaatacttgacaatattctcattcacaccaagagacaacttcaatgtattgtagatgatctcgaaccaacactgcaagaagaagttagatatgcattggagacacctcttttcagaagactcaacagagtacaggccaggcaattcatctcaacatacgagaaaagcactacgcgtatcaatatgctcctggagttctcaaaattagacttcaacatcttgctcaccctatactgtgaggagctaaaagatcttacgctgtggtggaaagagttccaagcacaggctaacacgacaatctatgcacgagataggatggtggagatgcatttctggatgatgggagtcttctttgagccccaatactcctattcacgaaagatgctcacgcagttgtttatgatcgtgtctgtactcgatgacttgtatgacagccattgcaccacagaggaaggcaacgccttcactgcagcattacaaaggtgggatgaagaaggcgtggagcaatgcccaacatacttgaggactctgtatacaaatatacgtgccaccataaaagccatcgaggaggacttgaattttcaaaacaacaaacatgcaaagttggtaaaaggactgataatcgacatggccatgtgctataatgccgagacagaatggcgtgacaagaaatatgtgccagccaccgttgatgaacatctgaaaatttcagcacgcagcagtggctgtatgcacttggtgagccaggggttcatttcgatgggagatgtggcaactagcgaggccctcgagtgggcctctacctatcccaaaatcgttcgagctgtctgtatcattgcacgcctcgctaatgatataatgtcgtacaagcgagaagcatcaaacaatactatggtgtctacagtgcaaacttgtgcaaaagaatacggcaccaccacagtagaacaggccatagaaaagatcagagagctgatcgaggaagcgtggatggacatcacccatgagtgcctcagacagccacagccgaaggctcttctagagagggcggtcaacctggctcgtacaatggattttctgtacaaagatgcggatggatacacagattcacggagtatcaaaggcatattggattcattgtatgtgcatctaatagactaa

SEQ ID NO: 683 - DNA, 1773 bp, Zea mays
  (E,E)-farnesol synthase
atggccatgccagtgaagctgactcctgcctccctctcgctgaaggcggtctgctgccgcttcagctccggagggcatgcgctgcgcttcggctcgtcgctaccgtgctggaggaggacgccgacgcaacggagcacgtcgtcgtctacgacgcgccctgcggctgaggttagctctggcaaaagcaagcagcacgatcaagaagcatcggaggctacgataagacagcagctccagctagtcgatgtgcttgagaacatggggatttctcggcattttgctgctgaaatcaaatgcatccttgacaggacatacagaagttggttacagagacatgaggaaattatgctggacacaatgacctgtgcgatggcatttcgtattctaaggttgaatggatacaatgtctcttctgatgagttgtatcatgttgttgaagcttccggactccataattcacttggaggatatctcaatgatacaagaaccttgttagaattacacaaggcctcgacagttagtatctctgaagatgagtctatcctggatagcataggctcaaggtcacgtaccttactgagggaacaactagagtctggtggtgctctacgaaaaccttcactctttaaagaggtggaacatgctctggacggtcccttctacaccacattggaccgtctacaccataggtggaacatcgaaaatttcaatattatagagcagcacatgctagagacaccatacttgtcaaatcaacataccagtagagatattctagcgttgagtattagagacttcagttcctctcagtttacttaccagcaagaacttcaacatcttgaaagctgggtgaaagagtgcaggttagaccagctacaatttgcgcgacagaagttggcatacttctacttgtctgctgctggcaccatgttctctcctgagctgtctgatgctcgaactttgtgggccaaaaatggtgtgctcacaactattgttgacgacttctttgatgttgcgggatcaaaagaagaacttgaaaaccttgtcatgttggttgagatgtgggacgagcatcacaaagttgagttctactcagaacaagtagagattatattttcttcaatttatgactcagttaaccaacttggtgaaaaggcttctttggtacaagaccgcagtattaccaaacacctagtagaaatatggttggatttgctaaagtctatgatgacagaggtagagtggcgtttgagcaaatatgtgccaacagagaaggaatacatgataaatgcatctttaatatttggactaggccccattgtattgccagcattatattttgttgggccaaagatctcagagtctattgttaaagatccagaatatgatgaattgttcaaactgatgagcacatgtggtcgcctcttgaatgatgttcagacttttgagagggagtacaacgagggcaagttgaatagtgtttctctcctcgttcttcatggtggccccatgtccatatcagacgccaaaaggaaattacagaagcccatagacacatgcagaagagacctcctaagtttagttcttcgtgaagaaagtgttgttcctaggccctgcaaggaattattttggaaaatgtgcaaggtgtgctacttcttctactcgacgacggatgggtttagctcacaagtggagagggctaaagaagtggatgcggtgatcaatgagccactaaagctacaaggaagtcatacgctggtgtctgatgtgtga

SEQ ID NO: 684 - DNA, 1665 bp, Zea mays
  sesquithujene synthase
atggcgtctcctccagcacatcgttccagcaaggcagctgatgaggagctgccaaaggcttcttcgaccttccacccaagcctgtggggcagtttcttcctgacctaccagccgccaactgcaccccagcgagcaaacatgaaagaacgagctgaggttttaagagaacgtgttaggaaggttttgaagggctcgacgactgatcaactaccagaaacagtgaatcttatattaacattgcaaagacttggactgggttactactacgagaacgagatagacaagttgctgcaccaaatttacagcaactccgattacaatgagaaagatcttaacttggtttcgcagcggttctaccttcttcgaaagaacggctacgatgtgccatcagatgtatttctgaacttcaaaacagaagaaggcggctttgcctgtgctgctgctgacacgagaagcttgttaagcttatataacgcagcatatctgaggaagcatggagaggaggtactagacgaagcgatttcatcgactagactccgcctccaagatctccttggacgacttcttccagaatcgccatttgcaaaggaggtgtcttcttcccttcgtacccctctcttcagaagggttgggatactagaagcgagaaactacatacccatttacgaaaaggaggcgacgcgaaatgaagccgtattggagcttgcgaaactgaattttaaccttcagcaacttgatttctgtgaagagctaaagcattgctcagcgtggtggaacgagatgatagccaaatcaaagctgacctttgttagagatagaattgtagaggagtatttctggatgaatggagcatgctgtgatccgccgtactccctttcccgaattatactgacaaagatcacggggcttattacaataatcgatgatatgtttgatacacatggtaccactgaagattgcatgaaattcgctgaagcatttggcagatgggacgaaagtgcaatacatctccttccagagtacatgaaggatttctacatattgatgttggagacatttcagtcatttgaggatgctttagggccagagaagagctaccgtgtgctttacctaaaacaggcgatggagcgtttagttgagctatactccaaggaaataaaatggcgtgatcaggattatgtggcgacaatgagtgaacacctccaggtttcagcagagtccatcggagccaatgctctaacatgttctgcatatgctgggatgggtgatatgtcgataacaaaggagaccttcgagtgggctttgagctttcctcaatttataagaacttttggttcatttgtacggctctccaacgatgtcgtatcgaccaagcgtgagcaaacaaaagaccatagtccctccactgtccattgttacatgaaggagcatggaacaaccatggacgatgcatgtgaaaagataaaggagcttatcgaagattcatggaaggatatgctagagcaatcccttgcgctgaaagggctcccaaaggttgtgccacagctagtgtttgacttctcaagaaccacggataatatgtacagggatcgtgacgcattgacctcttcggaagcactcaaggaaatgatacagctactgtttgtggagccaatacccgaatga

SEQ ID NO: 685 - DNA, 1665 bp, Zea mays
  S-beta-bisabolene synthase
atggcgtctcctccagcacatcgttccagcaaggcagctgatgaggagctgccaaaggcttcttcgacctttcacccaagtctgtggggcagtttcttcctgacctaccagccgccaactgcacctcagcgagcaaacatgaaagaacgagctgaggttttaagagaacgtgttaggaaggttttgaagggctcgacgactgatcaactaccagaaacagtgaatcttatattaacattgcaaagacttggactgggttactactacgagaacgagatagacaagttgctgcaccaaatttacagcaactccgattacaatgtgaaagatcttaacttggtttcgcagcggttctaccttcttcgaaagaacggctacgatgtgccatcagatgtatttctgagcttcaaaacagaagaaggcggcttcgcctgtgctgctgctgacacgagaagcttgttaagcttatataacgcagcatatctgaggaagcatggagaggaggtactagacgaagcgatttcatcgactagactccgcctccaagatctccttggacgacttcttccagaatcgccatttgcaaaggaggtgtcttcttcccttcgtacccctctcttcagaagggttgggatactagaagcgagaaactacatacccatttacgaaacggaggcgacgcgaaacgaagccgtattggagcttgcgaaactgaattttaaccttcagcaacttgatttctgtgaagagctaaagcattgctcagcgtggtggaacgagatgatagccaaatcaaagctgacctttgttagagatagaattgtagaggagtatttctggatgaatggagcatgctatgatccgccgtactccctttcccgaattatactgacaaagatcacgggacttattacaataatcgatgatatgtttgatacacatggtaccactgaagattgcatgaaattcgctgaagcgtttggcagatgggacgaaagtgcaatacatctccttccagagtacatgaaggatttctacatattgatgttggagacatttcagtcatttgaggatgctttagggccagagaagagctaccgtgtgctttacctaaaacaggcgatggagcgtttagttgagctatactccaaggaaataaaatggcgtgatgatgattatgtgccgacaatgagtgaacacctccaggtttcagcagagaccatcgcaaccattgctctaacatgttctgcatatgctgggatgggtgatatgtcgataagaaaggagaccttcgagtgggctttgagctttcctcaatttataagaacttttggttcatttgtacggctctccaacgatgtcgtatcgaccaagcgtgagcaaacaaaagaccatagtccctccactgtccattgttacatgaaggagcatggaacgaccatggacgatgcatgtgaaaagataaaggagcttatcgaagattcatggaaggatatgctagagcaatcccttgcgctgaaagggctcccaaaggttgtgccacagctagtgtttgacttctcaagaaccacggataatatgtacagggatcgtgacgcattgacctcttcggaagcactcaaggaaatgatacagctactgtttgtggagccaatacccgaatga

SEQ ID NO: 686 - DNA, 1644 bp, Zea mays
  (E)-beta-caryophyllene synthase
atggcagctgatgaggcaagatccgtcagcaggctccacagtgaggaggacatgcatgggaagcaccactccactctatggggtgacttcttccttcaccatgtcccatgtcgtccaggacagtatttgattatgaaggataacgtcgaaataatgaaggaggaggtgaagaaaatgttactggatgttggatcctctgatttgtctcataagttagactgcattgatacactagaacgacttggattggattaccactataccaaggagattgatgaattaatgtgcaatgtcttcgaagctagggatcaagatcttgatcttactacaacatcacaacttttctatttgcttaggaagcatggatatcatatttcttctgatgtatttttgaagttcagagatgataaaggagatattgtaacaaatgatgcaaggtgtttactgaggatgtacgaagcggcacatgttagagtgaacggtgaagaaatacttgacaatattctcattcacaccaagagacagcttcaatgtattgtagacgatctcgaaccaacactgcaagaagaagtgagatatgcattggagacacctcttttcagaagactcaacagagtacaagccaggcaattcatctcaacatacgagaaaagcactacgcgtaacaatatgctcctggagttctcaaagttagacttcaacatcttgctcaccctatattgtgaggagctaaaagatcttacgctgtggtggaaagagttccaagcacaggctaacacgacaatctatgcacgagataggatggtggagatgcatttctggatgatgggagtcttctttgagccccaatactcctattcacgaaagatgctcacacagttgtttatgatcgtgtctgtactcgatgacttgtatgacagccattgcaccacagaggaaggcaacgccttcactgcagcattacaaaggtgggatgaagaaggcgtggagcaatgcccaacatacttgaggactctgtatacaaatatacgtgccaccgtaaaagccatcgaggaggacttgaatcttcaaaacaacaaacatgcaaagttggtaaaaggactgataatcgacatggccatgtgctataatgccgagacagaatggcgtgacaagaaatatgtgccagccaccgttgatgaacatctgaaaatttcagcacgcagcagtggctgtatgcacttggtgagccaggggttcatttcgatgggagatgtggcaactagcgaggccctcgagtgggcctctacctatcccaaaatcgttcgagctgtctgtatcattgcacgcctcgctaacgatataatgtcgtacaagcgagaagcatcaaacaatactatggtgtctacagtgcaaacttgtgcaaaggaatacggcaccaccacagtagaacaggccatagaaaagatcagagagctgatcgaggaagcgtggatggacatcacccatgagtgcctcagacagccacagccgatggctcttctcgagagggcggtcaacctggctcgtacaatggattttctgtacaaagatgtggatggatacacagattcacggagtatcaaaggcatattggattcattgtatgtgcatctaatagactaa

SEQ ID NO: 687 - DNA, 1644 bp, Zea mays
  (E)-beta-caryophyllene synthase
atggcagctgatgaggcaagatccgtcagcaggctccacagtgaggaggacatgcatgggaagcaccactccactctatggggtgacttcttccttcaccatgtcccatgtcgtccaggacagtatttgattatgaaggataacgtcgaaataatgaaggaggaggtgaagaaaatgttactggatgttggatcctctgatttgtctcataagttagactgcattgatacactagaacggcttggactggattaccactataccaaggagattgatgaattaatgtgcaatgtcttcgaagctagggatcaagatcttgatcttactacaacatcacagcttttctatttgcttaggaagcatggatatcatatttcttctgatgtatttttgaagttcagagatgataaaggagatatcgtaacaaatgatgcaaggtgtttactgaggatgtacgaagcggcacatgttagagtgaacggtgaagaaatacttgacaatattctcattcacaccaagagacaacttcaatgtattgtagacgatctcgaaccaacactgcaagaagaagttagatatgcattggagacacctcttttcagaagactcaacagagtacaggccaggcaattcatctcaacatacgagaaaagcactacgcgtaacaatatgctcctggagttctcaaaattagacttcaacatcttgctcaccctatactgtgaggagctaaaagatcttacgctgtggtggaaagagttccaagcacaggctaacacgacaatctatgcacgagataggatggtggagatgcatttctggatgatgggagtcttctttgagccccaatactcctattcacgaaagatgctcacgcagttgtttatgatcgtgtctgtactcgatgacttgtatgatagccattgcaccacagaggaaggcaacgccttcactgcagcattacaaaggtgggatgaagaaggcgtggagcaatgcccaacatacttgaggactctgtatacaaatatacgtgccaccataaaagccatcgaggaggacttgaattttcaaaacaacaaacatgcaaagttggtaaaaggactgataatcgacatggccatgtgctataatgccgagacagaatggcgtgacaagaaatatgtgccagccaccgttgatgaacatctgaaaatttcagcacgcagcagtggctgtatgcacttggtgagccaggggttcatttcgatgggagatgtggcaactagcgaggccctcgagtgggcctctacctatcccaaaatcgttcgagctgtctgtatcattgcacgcctcgctaatgatataatgtcgtacaagcgagaagcatcaaacaatactatggtgtctacagtgcaaacttgtgcaaaagaatacggcaccaccacagtagaacaggccatagaaaagatcagagagctgatcgaggaagcgtggatggacatcacccatgagtgcctcagacagccacagccgaaggctcttctagagagggcggtcaacctggctcgtacaatggattttctgtacaaagatgcggatggatacacagattcacggagtatcaaaggcatattggattcattgtatgtgcatctaatagactaa

SEQ ID NO: 688 - DNA, 1644 bp, Zea perennis
  (E)-beta-caryophyllene synthase
atggcagctgatgaggcaagatccgtcagcaagctccacagtgaggaggacatgcatggcaagcaccactccactctatggggtgacttcttccttcaccatgtcccatgtcgtccaggacagtatttgattatgaaggataacgtcgaaataatgaaagaggaggtgaagaaaatgttactagatgttggatcctctgatttgtctcataagttagactgcattgatacactagaacggcttggattgggttaccactataccaaggagattgatgaattaatgtgcaatgtcttcgaagctagggatcaagatcttgatcttactacaacatcacaacttttctatttgcttaggaagcatggatatcatatttcttctgatgtatttttgaagttcagagatgataaaggagatatcgtaacagatgatgcaaggtgtttactgagaatgtacgaagcggcacatgttagagtgaacggtgaagaaatacttgacaatattctcagccacaccaagagacaacttcaatgtattgtagacgacctcgaaccaacactgcaagaagaagtgagatatgcattggagacacctcttttcagaagactcaacagagtacaggccaggcaattcatctcaacatacgagaaaagcactacgcgtaacaatatgctcctggaattctcaaagttagacttcaacatcttgctcaccctatactgtgaggagctaaaagatcttacgctgtggtggaaagagttccaagcacaggctaacacagcaatctatgcacgagataggatggtggagatgcatttctggatgatgggagtcttctttgagccccaatactcctattcacgaaagatgctcacacaattgtttatgatcgtgtctgtactcgatgacttgtatgacagccattgcaccacagaggaaggcaacaccttcactgcagcattacaaaggtgggatgaagaaggcgtggaacaatgcccaacatacttgaggaccttgtatacaaatatacgtgccaccgtaaaagccatcgaggaggacttgaatcttcaaaacaacaaacatgcaaagttggtaaaaggactgataatcgacatggccatgtgctataatgccgagacagaatggcgtgacaagaaatatgtgccagccaccgttgatgaacatctgaaaatttcagcacgcagcagtggctgtatgcacttggtgagccaggggttcatttcgatgggagatgtggcaactagcgagaccctcgagtgggcctctacctatcccaaaatcgttcgagctgtctgtatcattgcacgcctcgctaacgatataatgtcgtacaagcgagaagcatcaaacaatactatggtgtctacagtgcaaacttgtgcaaaagaatacggcaccaccacagtagaacaggccatagaaaagatcagagagctgatcgaggaagcgtggatggacgtcacccatgagtgcctcagacagccacagccgaaggctcttctagagagggcggtcaacctggctcgtacaatggattttctgtacaaagatgtggatggatacacagattcacggagtatcaaaggcatattggattcattgtatgtgcatctaatagactaa

SEQ ID NO: 689 - DNA, 1653 bp, Zingiber officinale
  germacrene D synthase
atggagaaccaatctctaacttttgttggtgatgaagaagcaaaggttcgtaagtcaacaaaatttcatccaagcatttggggtgattattttatccaaaactcctcgctctctcacgcagaggagtccactcaaaggatgataaagagggtggaagaattaaaggtgcaagtaaagagcatgttcaaggacactagtgacatattgcaacttatgaatttgattgattcaattcaaatgcttggattggactaccattttgagaatgaaatagataaagcactaagattgatcaatgaagttgatgataagagctatggactttatgaaacttctttaagatttcgattgcttaggcaacatggaaatcatgtatctacagatatttttaacaagttcaaaggtgacaatggaagctttatatcttccttgaatggagatgccaagggattattaagcttatataatgcgtcttatcttggaacacatggagagactatacttgatgaagccaagtcttttgcaaagcctcagcttatatccttattgagtgaacttgaacaatctttagccgcgcaggtcacacttttccttgagttaccacttcataaaagagtcaaaattctcttggtgagaaaatatatacttatttatcaagagggtgcaatgcgaaacaatgtcctattagaatttgcaaagttgaatttcaatttactacaatctctttatcaagaagaactgaagaaaatttcaatatggtggtatgatttagcacttgctaaatcactaagttttactcgtgaccgaattgtggaatgctattattgggttcttactttatattttgatcctcaatattctcattcccgattgatttactccaaagtgatttctcttgtatcaattatggatgatatctatgataactatggcacattggaagagtgcagacaattaactgaagcaatcaaaaggtggaaacctcaagctattgatagtttaccggaatatttgaaatatttctatctcaagctattaaagacttttgaagaaattggagaagagttggaacataatgagaaatatcgtatgctatatcttcaagatcaaataaaggctatagcggtagcttatcttgaagaagctaagtggagtattgagcgacatgtgccatcacttgatgaacacttgcattattcgttaattacctctgggtgttctttagtcccttgtgcctcttacgtaggtatgggagaagtggcaacaaaagaggtattcgactggcattctagttttcccaaggccgtagaagcttgttgtgcaattggaagaatcttgaatgatataacatcatatgagcgggagcaagggagaggcgataatgcctctacagtggaaagttacatgaaagatcatggtacaaatgaaaaagacgcatgtaagaagctgcaagagatagtagagaaagcatggaaggatctgaaccaagagtctcttaatcaaaaaaatatatctcgacttataattgaaagactggtcaacttttcaagatcaatggaagaaatatacatgtctaatgatatgtacaccaattccggcactaagatgaaaggtaatatcactttagtgttggttgaagcttttcctgtataa

SEQ ID NO: 690 - DNA, 1647 bp, Zingiber zerumbet
  alpha-humulene synthase
atggagaggcagtcgatggcccttgttggtgataaggaagagataattcgtaagtcatttgaatatcaccctactgtttggggtgactatttcatccggaactactcttgtttgcccctcgaaaaggagtgcatgataaagagggtggaagagttaaaagatcgagtgagaaacctattcgaggaaacacatgacgtattgcaaattatgattttggttgattcgattcaacttcttggattggattatcattttgagaaagaaataactgcggcactaagattgatttacgaggctgatgttgagaattatgggctttatgaagtttcccttcgatttagattgcttaggcaacatggatataatttgtctccagatgttttcaacaagttcaaagatgataagggcagatttttgccgaccttgaatggagatgcaaagggactactaaacttatacaatgcggcttatcttggaacacatgaagagactatactcgacgaagctatttcttttacaaagtgccaacttgaatctttgttgggtgaacttgagcagcctttagcaatagaggtgtctcttttccttgaaacaccactatatcgaagaactagaagactcttggtgagaaaatatatacctatttatcaagagaaagtgatgcgaaatgatactatattagaacttgcaaagttggatttcaatctactacaatctctccatcaagaggaagtgaagaaaattacaatatggtggaatgatttagcactgactaaatctttaaaatttgctcgtgaccgagtagtggaatgttattattggatagttgcggtgtattttgaacctcaatattctcgagcacgagtaattacttccaaggccatttctcttatgtcgattatggatgacatctatgataactacagcacattagaagaaagtcgactattaactgaggcaatcgaaaggtgggaaccccaagcagttgattgtgtaccagaatacttaaaagacttttatctcaagctattaaagacttacaaagatttcgaagatgaactagaacccaatgaaaagtatcgcataccatatcttcaagaggaaataaaagttctatcaagagcttatttccaagaagctaaatggggtgtggaaagatatgtaccagcactcgaggagcatcttcttgtttcattgataacagccgggtattttgcggttgcatgtgcctcttacgtaggtttgggagaagatgcaacaaaagagacatttgaatgggttgctagttcccctaagatccttaaatcctgcagtatacattgtagacttatggatgatataacttcacaccagcgggaacaagaaagagaccatttcgcttcaacagttgagagttacatgaaagagcatggtacaagtgcaaaagtggcttgcgagaagttgcaagtgatggtggagcaaaaatggaaggatttgaacgaggaatgcctacgtccaacacaagtagctcggcctttaattgaaataatattgaacctctcaagagccatggaagacatatacaagcacaaagatacttatactaattccaacactaggatgaaagacaatgtctctctcatatttgttgaatcctttcttatttaa

SEQ ID NO: 691 - DNA, 1665 bp, Zingiber zerumbet
  beta-eudesmol synthase
atggagaagcaatcactaacttttgatggtgatgaagaagcaaaaatcgatcgtaagtcatcaaaatatcatccaagcatttggggtgattattttatccaaaattcctcgctcactcatgcaaaggagtccactcaaaggatgataaagagagtggaagaattaaaggtgcaagtaaagagcatgttcaaggacactagtgacttattgcaacttatgaatttgattaattcaattcaaatgcttggattggactaccatttcgagaatgaaatagatgaagcactaagattgatttatgaagttgatgataaaagctatgggctttatgaaacttctctaagatttcaattgcttaggcaacatggatatcatgtatctgcagatatttttaacaagttcaaagatgacaatggaagctttatatcttccttgaatggagatgccaagggattattaagcttatataatgtgtcttatcttggaacacatggagagactatacttgatgaagccaagtcttttacaaagccacagcttgtatcattaatgagtgaacttgaacaatctttagccgcgcaggtctctcttttccttgagttaccactatgtcgaagaaataaaattctcttggcgcgaaaatatatacttatttatcaagaagatgcaatgcgaaacaatgtcatattagaacttgcaaagttgaatttcaatttactacaatctctttatcaagaggaattgaagaaaatttcaatatggtggaatgatttagcatttgctaagtctctaagttttactcgtgaccgagttgtggaaggttattattgggttcttactatatattttgagcctcagcattctcgtgcacgagtgatttgctccaaagtatttgcttttctatcaattatggatgatatttatgataactatggcatattggaagagtgtacactattaactgaagcaatcaaaaggtggaatcctcaagctattgacggtttaccagaatacttgaaagattactatctcaagctattaaagactttcgaagaatttgaagatgagttggaacttaatgagaagtatcgtatgctatatcttcaagatgaagtaaaggctctagcaatatcttatcttcaagaagctaagtggggtatcgagcgacatgtgccatcacttgacgaacacttgcataattcattaatctccagtgggagttctacagtcatttgtgcctcttttgtaggtatgggggaagtggcaacaaaagaggtgttcgactggctttctagttttcccaaggttgtagaagcttgttgtgtaattggtagactcttgaatgatataagatcacatgagctggagcaagggagagatcacactgcctctacagtggaaagttacatgaaagagcatgacacaaatgtagatgttgcatgcgagaagctgcgagagatagtagagaaagcgtggaaggatctaaacaacgagtcacttaatccaacaaaagtacctcgacttatgattgaaagaatagtcaacctttcaaaatcaaatgaagaaatatacaagtataacgatacgtacaccaattctgacactacgatgaaagataatatctctttggtgttagttgaatcttgtgactacttcaataagtaa

SEQ ID NO: 692 - DNA, 5181 bp, Artificial Sequence
  YEP352-URA plasmid
atgaccatgattacgaattcgagctcggtacccggggatcctctagagtcgacctgcaggcatgcaagcttggcactggccgtcgttttacaacgtcgtgactgggaaaaccctggcgttacccaacttaatcgccttgcagcacatccccccttcgccagctggcgtaatagcgaagaggcccgcaccgatcgcccttcccaacagttgcgcagcctgaatggcgaatggcgcctgatgcggtattttctccttacgcatctgtgcggtatttcacaccgcatagggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaagaaaccgaaatcaaaaaaaagaataaaaaaaaaatgatgaattgaaaagctcttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatccagctggcacgacaggtttcccgactggaaagcgggcagtgagcgcaacgcaattaatgtgagttacctcactcattaggcaccccaggctttacactttatgcttccggctcgtatgttgtgtggaattgtgagcggataacaatttcacacaggaaacagct

SEQ ID NO: 693 - DNA, 1647 bp, Artificial Sequence
  CVS mutant V182
atgtcatctggtgaaacttttagaccaactgctgattttcatccatctttgtggagaaatcattttttgcaaggtgcatcagattttaagactgttgatcatacagctacaaatgaaagacatgaagctttgaaggaagaagttagaagaatgattactgatgcagaagatcaaccaattcaaaaattgagattgattgatgaagttcaaagattgggtgttgcttaccattttgaaaaagaaattgaagatgctattcaacaattgtgtccaattcatattgattctgataaagctgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttgggtacttattttgaaccacaatacgcttttggtagaaaaatcatgactaaattaaactacattttgtccattattgatgatacctacgatgcttacggtactttgcccgaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 694 - DNA, 1647 bp, Artificial Sequence
  CVS mutant V183
atgtcatctggtgaaacttttagaccaactgctgattttcatccatctttgtggagaaatcattttttgcaaggtgcatcagattttaagactgttgatcatacagctacaaatgaaagacatgaagctttgaaggaagaagttagaagaatgattactgatgcagaagatcaaccaattcaaaaattgagattgattgatgaagttcaaagattgggtgttgcttaccattttgaaaaagaaattgaagatgctattcaacaattgtgtccaattcatattgattctgataaagctgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttgggtacttattttgaaccacaatacgcttttggtagaaaaatcatgactaaattgaactacattttgtccattattgatgatacctacgatgcttacggtactttggaagaattgtctttgttcagtgaagctggggctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 695 - DNA, 1647 bp, Artificial Sequence
  CVS mutant 194
atgcagagcattacggacaagagaccaactgctgattttcatccatctttgtggagaaatcattttttgcaaggtgcatcagattttaagactgttgatcatacagctacaaatgaaagacatgaagctttgaaggaagaagttagaagaatgattactgatgcagaagatcaaccaattcaaaaattgagattgattgatgaagttcaaagattgggtgttgcttaccattttgaaaaagaaattgaagatgctattcaacaattgtgtccaattcatattgattctgataaagctgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttgggtacttattttgaaccacaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 696 - DNA, 1647 bp, Artificial Sequence
  CVS mutant V196
atgtcatctggtgaaacttttagaccaactgctgattttcatccatctttgtggagaaatcattttttgcaaggtgcatcagattttaagactgttgatcatacagctacaaatgaaagacatgaagctttgaaggaagaagttagaagaatgattactgatgcagaagatcaaccaattcaaaaattgagattgattgatgaagttcaaagattgggtgttgcttaccattttgaaaaagaaattgaagatgctattcaacaattgtgtccaattcatattgattctgataaagctgatttgcatactgtttctgcccatttcagattgttgagacaacaaggtattaagatttcttgtgatgttttcgaacaatttaaggatgatgaaggtagattcaaaagttctttgattaatgatgttcaaggcatgttgtccttgtatgaagctgcttatatggctgttagaggtgaacatattttggatgaagctattgcatttactactactcatttgcaatcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttgggtacttattttgaaccacaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 697 - DNA, 1647 bp, Artificial Sequence
  CVS mutant V197
atgtcatctggtgaaacttttagaccaactgctgattttcatccatctttgtggagaaatcattttttgcaaggtgcatcagattttaagactgttgatcatacagctacaaatgaaagacatgaagctttgaaggaagaagttagaagaatgattactgatgcagaagatcaaccaattcaaaaattgagattgattgatgaagttcaaagattgggtgttgcttaccattttgaaaaagaaattgaagatgctattcaacaattgtgtccaattcatattgattctgataaagctgatttgcatactgtttcttcgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttgggtacttattttgaaccacaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 698 - DNA, 1647 bp, Artificial Sequence
  CVS mutant V198
atgtcatctggtgaaacttttagaccaactgctgattttcatccatctttgtggagaaatcattttttgcaaggtgcatcagattttaagactgttgatcatacagctacaaatgaaagacatgaagctttgaaggaagaagttagaagaatgattactgatgcagaagatcaaccaattcaaaaattgagattgattgatgaagttcaaagattgggtgttgcttaccattttgaaaaagaaattgaagatgctattcaacaattgtgtccaattcatattgattctgataaagctgatttgcatactgtttctaagcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttgggtacttattttgaaccacaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 699 - DNA, 1647 bp, Artificial Sequence
  CVS mutant V200
atgtcatctggtgaaacttttagaccaactgctgattttcatccatctttgtggagaaatcattttttgcaaggtgcatcagattttaagactgttgatcatacagctacaaatgaaagacatgaagctttgaaggaagaagttagaagaatgattactgatgcagaagatcaaccaattcaaaaattgagattgattgatgaagttcaaagattgggtgttgcttaccattttgaaaaagaaattgaagatgctattcaacaattgtgtccaattcatattgattctgataaagctgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttataatgctgttagaggtgaacatattttggatgaagctattgcatttactactactcatttgcaatcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttgggtacttattttgaaccacaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttgatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccacggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 700 - DNA, 1647 bp, Artificial Sequence
  CVS mutant V202
atgtcatctggtgaaacttttagaccaactgctgattttcatccatctttgtggagaaatcattttttgcaaggtgcatcagattttaagactgttgatcatacagctacaaatgaaagacatgaagctttgaaggaagaagttagaagaatgattactgatgcagaagatcaaccaattcaaaaattgagattgattgatgaagttcaaagattgggtgttgcttaccattttgaaaaagaaattgaagatgctattcaacaattgtgtccaattcatattgattctgataaagctgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatcattggttgcacaagatcatgttactccaagattggctgaacaaattaaccatgctttgtatagaccattgagaaaaactttgccaagattggaagcaagatacattatgtcaagaattgattctacttctgatgccttggttaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttgggtacttattttgaaccacaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 701 - DNA, 1647 bp, Artificial Sequence
  CVS mutant V208
  variation 1334, 1336: n = a or c or t or g
atgtcatctggtgaaacttttagaccaactgctgattttcatccatctttgtggagaaatcattttttgcaaggtgcatcagattttaagactgttgatcatacagctacaaatgaaagacatgaagctttgaaggaagaagttagaagaatgattctccctcgcttctcgcaaccaattcaaaaattgagattgattgatgaagttcaaagattgggtgttgcttaccattttgaaaaagaaattgaagatgctattcaacaattgtgtccaattcatattgattctgataaagctgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttgggtacttattttgaaccacaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggncnatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 702 - DNA, 1641 bp, Artificial Sequence
  CVS mutants V232, V233, V234 and V235
atgtcatctggtgaaacttttagaccaactgctgattttcatccatctttgtggagaaatcattttttgcaaggtgcatcagattttaagactgttgatcatacagctacaaatgaaagacatgaagctttgaaggaagaagttagaagaatgattactgatgcagaagatcaaccaattcaaaaattgagattgattgatgaagttcaaagattgggtgttgcttaccattttgaaaaagaaattgaagatgctattcaacaattgtgtccaattcatattgattctgataaagctgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttaccactactcatttgcaatctgcagctccacatttgaagtcacctttggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttggggacttattttgaatcacaatacgcttttggtagaaaaatcatgactaaattgaactacattttgtccattattgatgatacctacgatgcttacggtactttggaagaatgcacgatgttcagtgaagctgttgctcgttggaacattgaagctgttgatatgttgccagattatatgcgaattatctacagaactttgttggatacattcaacgaaatagaagaggatatggctaaacaacggagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 703 - DNA, 1641 bp, Artificial Sequence
  CVS mutants V237 and V238
atgcgggacaagggtacgtgtagaccaactgctgattttcatccatctttgtggagaaatcattttttgcaaggtgcatcagattttaagactgttgatcatacagctacaaatgaaagacatgaagctttgaaggaagaagttagaagaatgattactgatgcagaagatcaaccaattcaaaaattgagattgattgatgaagttcaaagattgggtgttgcttaccattttgaaaaagaaattgaagatgctattcaacaattgtgtccaattcatattgattctgataaagctgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatctgcagctccacatttgaagtcacctttggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttggggacttattttgaatcacaatacgcttttggtagaaaaatcatgactaaattgaactacattttgtccattattgatgatacctacgatgcttacggtactttggaagaatgcacgatgttcagtgaagctgttgctcgttggaacattgaagctgttgatatgttgccagattatatgcgaattatctacagaactttgttggatacattcaacgaaatagaagaggatatggctaaacaacggagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagatgttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 704 - DNA, 1647 bp, Artificial Sequence
  CVS mutant V209
atgtcatctggtgaaacttttagaccaactgctgattttcatccatctttgtggagaaatcattttttgcaaggtgcatcagattttaagactgttgatcatacagctacaaatgaaagacatgaagctttgaaggaagaagttagaagaatgattacggccgttgcccagcccccaattcaaaaattgagattgattgatgaagttcaaagattgggtgttgcttaccattttgaaaaagaaattgaagatgctattcaacaattgtgtccaattcatattgattctgataaagctgatttgcatactgtttctttccatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttgggtacttattttgaaccacaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 705 - DNA, 1647 bp, Artificial Sequence
  CVS mutant V210
atgtcatctggtgaaacttttagaccaactgctgattttcatccatctttgtggagaaatcattttttgcaaggtgcatcagattttaagactgttgatcatacagctacaaatgaaagacatgaagctttaaaggaagaagttagaagaatgattcgagcacaaaccgcccggccaattcaaaaattgagattgattgatgaagttcaaagattgggtgttgcttaccattttgaaaaagaaattgaagatgctattcaacaattgtgtccaatccatattgattctgataaagctgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttgggtacttattttgaaccacaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttacttgattaaggaacaaatagcatctgttttgggtgatcatgttccattttaa

SEQ ID NO: 706 - DNA, 1647 bp, Artificial Sequence
  CVS mutant V211
atgtcatctggtgaaacttttagaccaactgctgattttcatccatctttgtggagaaatcattttttgcaaggtgcatcagattttaagactgttgatcatacagctacaaatgaaagacatgaagctttgaaggaagaagttagaagaatgattcggtgcgttcagccagagccaattcaaaaattgagattgattgatgaagttcaaagattgggtgttgcttaccattttgaaaaagaaattgaagatgctattcaacaattgtgtccaattcatattgattctgataaagctgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtggcaagatttggattttactactaaattgccatatgccagagatagattggttgaattgtacttttgggatttgggtacttattttgaaccacaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 707 - DNA, 1647 bp, Artificial Sequence
  CVS mutant V212
atgtcatctggtgaaacttttagaccaactgctgattttcatccatctttgtggagaaatcattttttgcaaggtgcatcagattttaagactgttgatcatacagctacaaatgaaagacatgaagctttgaaggaagaagttagaagaatgattactgatgcagaagatcaaccaattcaaaaattgagattgattgatgaagttcaaagattgggtgttgcttaccattttgaaaaagaaattgaagatgctattcaacaattgtgtccaattcatattgattctgataaagctgatttgcatactgtttctttgcatttcagattgttgagacaacaaggtattaagatttcttgtgatgttttcgaacaatttaaggatgatgaaggtggattcaaaagttctttgattaatgatgttcaaggcatgttgtctttgtatgaagctgcttatatggctgttagaggtgaacatattttggatgaagctattgcatttactactactcatttgcaatcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttgggtacttattttgaaccacaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 708 - DNA, 1647 bp, Artificial Sequence
  CVS mutant V213
atgtcatctggtgaaacttttagaccaactgctgattttcatccatctttgtggagaaatcattttttgcaaggtgcatcagattttaagactgttgatcatacagctacaaatgaaagacatgaagctttgaaggaagaagttagaagaatgattactgatgcagaagatcaaccaattcaaaaattgagattgattgatgaagttcaaagattgggtgttgcttaccattttgaaaaagaaattgaagatgctattcaacaattgtgtccaattcatattgattctgataaagctgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacaaattttggatgaagctattgcatttactactactcatttgcaatcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttgggtacttattttgaaccacaatacgcttttggtagaaaaatcatgactaaattgaactacattttgtccattattgatgatacctacgatgcttacggtactttggaagaattgtctttgttcaccgaggctgttgctcgttggaacattgaggctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactatcgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 709 - DNA, 1647 bp, Artificial Sequence
  CVS mutant V214
atgtcatctggtgaaacttttagaccaactgctgattttcatccatctttgtggagaaatcattttttgcaaggtgcatcagattttaagactgttgatcatacagctacaaatgaaagacatgaagctttgaaggaagaagttagaagaatgattactgatgcagaagatcaaccaattcaaaaattgagattgattgatgaagttcaaagattgggtgttgcttaccattttgaaaaagaaattgaagatgctattcaacaattgtgtccaattcatattgattctgataaagctgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatggggctgttagaggtgaacatattttggatgaagctattgcatttactactactcatttgcaatcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttgggtacttattttgaaccacaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 710 - DNA, 1647 bp, Artificial Sequence
  CVS mutant V215
atgtcatctggtgaaacttttagaccaactgctgattttcatccatctttgtggagaaatcattttttgcaaggtgcatcagattttaagactgttgatcatacagctacaaatgaaagacatgaagctttgaaggaagaagttagaagaatgattactgatgcagaagatcaaccaattcaaaaattgagattgattgatgaagttcaaagattgggtgttgcttaccactttgaaaaagaaattgaagatgctattcaacaattgtgtccaattcatattgattctgataaagctgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttgggtacttattttgaaccacaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccagttgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 711 - DNA, 1647 bp, Artificial Sequence
  CVS mutant V216
atgtcatctggtgaaacttttagaccaactgctgattttcatccatctttgtggagaaatcattttttgcaaggtgcatcagattttaagactgttgatcatacagctacaaatgaaagacatgaagctttgaaggaagaagttagaagaatgattactgatgcagaagatcaaccaattcaaaaattgagattgattgatgaagttcaaagattgggtgttgcttaccattttgaaaaagaaattgaagatgctattcaacaattgtgtccaattcatattgattctgataaagctgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatcattggttgcacaagatcatgttactccaagattggctgaacaaatcaaccatgctttgtatagaccattgagaaaaactttgccaaggttggaagcaagatacattatgtcaagaattgattctacttctgatgatttggttaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttgggtacttattttgaaccacaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 712 - DNA, 1635 bp, Artificial Sequence
  CVS mutant V217 (encoding AA5-548)
gaaacttttagaccaactgctgattttcatccatctttgtggagaaatcattttttgcaaggtgcatcagattttaagactgttgatcatacagctacaaatgaaagacatgaagctttgaaggaagaagttagaagaatgattactgatgcagaagatcaaccaattcaaaaattgagattgattgatgaagttcaaagattgggtgttgcttaccattttgaaaaagaaattgaagatgctattcaacaattgtgtccaattcatattgattctgataaagctgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatcattggttgcacaagatcatgttactccaagattggctgaacaagcgaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttgggtacttattttgaaccacaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 713 - DNA, 1650 bp, Artificial Sequence
  CVS mutant V239
atgtcatctggtgaaacttttagaccaactgctgattttcatccatctttgtggagaaatcattttttgcaaggtgcatcagattttaagactgttgatcatacagctacaaatgaaagacatgaagctttgaaggaagaagttagaagaatgattttagcaaccggaaggaaaccaattcaaaaattgagattgattgatgaagttcaaagattgggtgttgcttaccattttgaaaaagaaattgaagatatgttggatcacatttacagagctgatccttattttgaggctcatgaatacaatgatttgcatactgtttctttgcatttcagattgtcgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatctgcagctccacatttgaagtcacctttggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttggggacttattttgaatcacaatacgcttttggtagaaaaatcatgactaaattgaactacattttgtccattattgatgatacctacgatgcttacggtactttggaagaatgcacgatgttcagtgaagctgttgctcgttggaacattgaagctgttgatatgttgccagattatatgcgaattatctacagaactttgttggatacattcaacgaaatagaagaggatatggctaaacaacggagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagatgttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 714 - DNA, 1650 bp, Artificial Sequence
  CVS mutant V240
atgtcatctggtgaaacttttagaccaactgctgattttcatccatctttgtggaaaaatcattttttgcaaggtgcatcagattttaagactgttgatcatacagctacaaatgaaagacatgaagctttgaaggaagaagttagaagaatgattttagcaaccggaaggaaaccaattcaaaaattgagattgattgatgaagttcaaagattgggtgttgcttaccattttgaaaaagaaattgaagatatgttggatcacatttacagagctgatccttattttgaggctcatgaatacaatgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatctgcagctccacatttgaagtcacctttggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttggggacttattttgaatcacaatacgcttttggtagaaaaatcatgactaaattgaactacattttgtccattattgatgatacctacgatgcttacggtactttggaagaatgcacgatgttcagtgaagctgttgctcgttggaacattgaagctgttgatatgttgccagattatatgcgaattatctacagaactttgttggatacattcaacgaaatagaagaggatatggctaaacaacggagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagatgttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 715 - DNA, 1650 bp, Artificial Sequence
  CVS mutant V241
atgtcatctggtgaaacttttagaccaactgctgattttcatccatctttgtggagaaatcattttttgcaaggtgcatcagattttaagactgttgatcatacagctacaaatgaaagacatgaagctttgaaggaagaagttagaagaatgattttagcaaccggaaggaaaccaattcaaagattgagattgattgatgaagttcaaagattgggtgttgcttaccattttgaaaaagaaattgaagatatgttggatcacatttacagagctgatccttattttgaggctcatgaatacaatgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatctgcagctccacatttgaagtcacctttggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttggggacttattttgaatcacaatacgcttttggtagaaaaatcatgactaaattgaactacattttgtccattattgatgatacctacgatgcttacggtactttggaagaatgcacgatgttcagtgaagctgttgctcgttggaacattgaagctgttgatatgttgccagattatatgcgaattatctacagaactttgttggatacattcaacgaaatagaagaggatatggctaaacaacggagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaggtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagatgttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 716 - DNA, 1647 bp, Artificial Sequence
  CVS mutants V218 and V219
atgtcatctggtgaaacttttagaccaactgctgattttcatccatctttgtggagaaatcattttttgcaaggtgcatcagattttaagactgttgatcatacagctacaaatgaaagacatgaagctttgaaggaagaagttagaagaatgattactgatgcagaagatcaaccaattcaaaaattgagattgattgatgaagttcaaagattgggtgttgcttaccattttgaaaaagaaattgaagatgctattcaacaattgtgtccaattcatattgattctgataaagctgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttgggtacttattttgaaccacaatacgcttttggtagaaaaatcatgactaaattgaactacattttgtccattattgatgatacctacgatgcttacggtactcaccccgaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 717 - DNA, 1647 bp, Artificial Sequence
  CVS mutant V185
atgtcatctggtgaaacttttagaccaactgctgattttcatccatctttgtggagaaatcattttttgcaaggtgcatcagattttaagactgttgatcatacagctacaaatgaaagacatgaagctttgaaggaagaagttagaagaatgattactgatgcagaagatcaaccaattcaaaaattgagattgattgatgaagttcaaagattgggtgttgcttaccattttgaaaaagaaattgaagatgctattcaacaattgtgtccaattcatattgattctgataaagctgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttgggtacttattttgaaccacaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcacaaggttattggtgactattacgttcaagctaagtggttttctgaaggttatgtccctactattgaagaatacatgccaattgctttgacttcttgcgcttacagatttgttattggcaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaaggattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 718 - DNA, 1647 bp, Artificial Sequence
  CVS mutant V220
atgtcatctggtgaaacttttagaccaactgctgattttcatccatctttgtggagaaatcattttttgcaaggtgcatcagattttaagactgttgatcatacagctacaaatgaaagacatgaagctttgaaggaagaagttagaagaatgattactgatgcagaagatcaaccaattcaaaaattgagattgattgatgaagttcaaagattgggtgttgcttaccattttgaaaaagaaattgaagatgctattcaacaattgtgtccaattcatattgattctgataaagctgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatcattggttgcacaagatcatgttactccaagattggctgaacaaattaaccatgctctgtatagaccattgagaaaaactttgccaagattggaagcaagatacattatgtcaaattatctgaggcgtattcccgcagattctaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttggggacttattttgaatcacaatacgcttttggtagaaaaatcatgactaaattgaactacattttgtccattattgatgatacctacgatgcttacggtactttggaagaatgcacgatgttcagtgaagctgttgctcgttggaacattgaagctgttgatatgttgccagattatatgcgaattatctacagaactttgttggatacattcaacgaaatagaagaggatatggctaaacaacggagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 719 - DNA, 1647 bp, Artificial Sequence
  CVS mutant V221
atgtcatctggtgaaacttttagaccaactgctgattttcatccatctttgtggagaaatcattttttgcaaggtgcatcagattttaagactgttgatcatacagctacaaatgaaagacatgaagctttgaaggaagaagttagaagaatgattactgatgcagaagatcaaccaattcaaaaattgagattgattgatgaagttcaaagattgggtgttgcttaccattttgaaaaagaaattgaagatgctattcaacaattgtgtccaattcatattgattctgataaagctgatttgcatactgtttctttgcatttcagattgttgagacgacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatcattggttgcacaagatcatgttactccaagattggctgaacaaattaaccatgctttgtatagaccattgagaaaaactttgccaagattggaagcaagatacattatgtcagactatgagcaccaatctattttagttcaaaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttggggacttattttgaatcacaatacgcttttggtagaaaaatcatgactaaattgaactacattttgtccattattgatgatacctacgatgcttacggtactttggaagaatgcacgatgttcagtgaagctgttgctcgttggaacattgaagctgttgatatgttgccagattatatgcgaattatctacagaactttgttggatacattcaacgaaatagaagaggatatggctaaacaacggagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 720 - DNA, 1647 bp, Artificial Sequence
  CVS mutant V224
atgtcatctggtgaaacttttagaccaactgctgattttcatccatctttgtggagaaatcattttttgcaaggtgcatcagattttaagactgttgatcatacagctacaaatgaaagacatgaggctttgaaggaagaagttagaagaatgattactgatgcagaagatcaaccaattcaaaaattgagattgattgatgaagttcaaagattgggtgttgcttaccattttgaaaaagaaattgaagatgctattcaacaattgtgtccaattcatattgattctgataaagctgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatcattggttgcacaagatcatgttactccaagattggctgaacaaattaaccatgctttgtatagaccattgagaaaaactttgccaagattggaagcaagatacattatgtcaaatatgtcttcgtaccgggggtgcagcgtgaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttggggacttattttgaatcacaatacgcttttggtagaaaaatcatgactaaattgaactacattttgtccattattgatgatacctacgatgcttacggtactttggaagaatgcacgatgttcagtgaaactgttgctcgttggaacattgaagctgttgatatgttgccagattatatgcgaattatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 721 - DNA, 1647 bp, Artificial Sequence
  CVS mutant V225
atgtcatctggtgaaacttttagaccaactgctgattttcatccatctttgtggagaaatcattttttgcaaggtgcatcagattttaagactgttgatcatacagctacaaatgaaagacatgaagctttgaaggaagaagttagaagaatgattactgatgcagaagatcaaccaattcaaaaattgagattgattgatgaagttcaaagattgggtgttgcttaccattttgaaaaagaaattgaagatgctattcaacaattgtgtccaattcatattgattctgataaagctgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatcattggttgcacaagatcatgttactccaagattggctgaacaaattaaccatgctttgtatagaccattgagaaaaactttgccaagattggaagcaagatacattatgtcagatgcaaacggtgaaaaggtcttgagttttaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttggggacttattttgaatcacaatacgcttttggtagaaaaatcatgactaaattgaactacattttgtccattattgatgatacctacgatgcttacggtactttggaagaatgcacgatgttcagtgaagctgttgctcgttggaacattgaagctgttgatatgttgccagattatatgcgaattatctacagaactttgttggatacattcaacgaaatagaagaggatatggctaaacaacggagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 722 - DNA, 1647 bp, Artificial Sequence
  CVS mutant V226
atgtcatctggtgaaacttttagaccaactgctgattttcatccatctttgtggagaaatcattttttgcaaggtgcatcagattttaagactgttgatcatacagctacaaatgaaagacatgaagctttgaaggaagaagttagaagaatgattactgatgcagaagatcaaccaattcaaaaattgagattgattgatgaagttcaaagattgggtgttgcttaccattttgaaaaagaaattgaagatgctattcaacaattgtgtccaattcatattgattctgataaagctgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatcattggttgcacaagatcatgttactccaagattggctgaacaaattaaccatgctttgtatagaccattgagaaaaactttgccaagattggaagcaagatacattatgtcatcacgttccaagccgttttgctggacctccaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttgggtacttattttgaaccacaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcctgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 723 - protein, 548 aa, Artificial Sequence
  CVS mutant V182
MSSGETFRPTADFHPSLWRNHFLQGASDFKTVDHTATNERHEALKEEVRRMITDAEDQPIQKLRLIDEVQRLGVAYHFEKEIEDAIQQLCPIHIDSDKADLHTVSLHFRLLRQQGIKISCDVFEQFKDDEGRFKSSLINDVQGMLSLYEAAYMAVRGEHILDEAIAFTTTHLQSLVAQDHVTPRLAEQINHALYRPLRKTLPRLEARYIMSRIDSTSDDLVNKTLLNFAKLDFNILLDLHKEELNELTKWWQDLDFTTKLPYARDRLVELYFWDLGTYFEPQYAFGRKIMTKLNYILSIIDDTYDAYGTLPELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 724 - protein, 548 aa, Artificial Sequence
  CVS mutant V183
MSSGETFRPTADFHPSLWRNHFLQGASDFKTVDHTATNERHEALKEEVRRMITDAEDQPIQKLRLIDEVQRLGVAYHFEKEIEDAIQQLCPIHIDSDKADLHTVSLHFRLLRQQGIKISCDVFEQFKDDEGRFKSSLINDVQGMLSLYEAAYMAVRGEHILDEAIAFTTTHLQSLVAQDHVTPRLAEQINHALYRPLRKTLPRLEARYIMSRIDSTSDDLVNKTLLNFAKLDFNILLDLHKEELNELTKWWQDLDFTTKLPYARDRLVELYFWDLGTYFEPQYAFGRKIMTKLNYILSIIDDTYDAYGTLEELSLFSEAGARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 725 - protein, 548 aa, Artificial Sequence
  CVS mutant V194
MQSITDKRPTADFHPSLWRNHFLQGASDFKTVDHTATNERHEALKEEVRRMITDAEDQPIQKLRLIDEVQRLGVAYHFEKEIEDAIQQLCPIHIDSDKADLHTVSLHFRLLRQQGIKISCDVFEQFKDDEGRFKSSLINDVQGMLSLYEAAYMAVRGEHILDEAIAFTTTHLQSLVAQDHVTPRLAEQINHALYRPLRKTLPRLEARYIMSRIDSTSDDLVNKTLLNFAKLDFNILLDLHKEELNELTKWWQDLDFTTKLPYARDRLVELYFWDLGTYFEPQYAFGRKIMTKLNYILSIIDDTYDAYGTLEELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 726 - protein, 548 aa, Artificial Sequence
  CVS mutant V196
MSSGETFRPTADFHPSLWRNHFLQGASDFKTVDHTATNERHEALKEEVRRMITDAEDQPIQKLRLIDEVQRLGVAYHFEKEIEDAIQQLCPIHIDSDKADLHTVSAHFRLLRQQGIKISCDVFEQFKDDEGRFKSSLINDVQGMLSLYEAAYMAVRGEHILDEAIAFTTTHLQSLVAQDHVTPRLAEQINHALYRPLRKTLPRLEARYIMSRIDSTSDDLVNKTLLNFAKLDFNILLDLHKEELNELTKWWQDLDFTTKLPYARDRLVELYFWDLGTYFEPQYAFGRKIMTKLNYILSIIDDTYDAYGTLEELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 727 - protein, 548 aa, Artificial Sequence
  CVS mutant V197
MSSGETFRPTADFHPSLWRNHFLQGASDFKTVDHTATNERHEALKEEVRRMITDAEDQPIQKLRLIDEVQRLGVAYHFEKEIEDAIQQLCPIHIDSDKADLHTVSSHFRLLRQQGIKISCDVFEQFKDDEGRFKSSLINDVQGMLSLYEAAYMAVRGEHILDEAIAFTTTHLQSLVAQDHVTPRLAEQINHALYRPLRKTLPRLEARYIMSRIDSTSDDLVNKTLLNFAKLDFNILLDLHKEELNELTKWWQDLDFTTKLPYARDRLVELYFWDLGTYFEPQYAFGRKIMTKLNYILSIIDDTYDAYGTLEELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 728 - protein, 548 aa, Artificial Sequence
  CVS mutant V198
MSSGETFRPTADFHPSLWRNHFLQGASDFKTVDHTATNERHEALKEEVRRMITDAEDQPIQKLRLIDEVQRLGVAYHFEKEIEDAIQQLCPIHIDSDKADLHTVSKHFRLLRQQGIKISCDVFEQFKDDEGRFKSSLINDVQGMLSLYEAAYMAVRGEHILDEAIAFTTTHLQSLVAQDHVTPRLAEQINHALYRPLRKTLPRLEARYIMSRIDSTSDDLVNKTLLNFAKLDFNILLDLHKEELNELTKWWQDLDFTTKLPYARDRLVELYFWDLGTYFEPQYAFGRKIMTKLNYILSIIDDTYDAYGTLEELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 729 - protein, 548 aa, Artificial Sequence
  CVS mutant V200
MSSGETFRPTADFHPSLWRNHFLQGASDFKTVDHTATNERHEALKEEVRRMITDAEDQPIQKLRLIDEVQRLGVAYHFEKEIEDAIQQLCPIHIDSDKADLHTVSLHFRLLRQQGIKISCDVFEQFKDDEGRFKSSLINDVQGMLSLYEAAYNAVRGEHILDEAIAFTTTHLQSLVAQDHVTPRLAEQINHALYRPLRKTLPRLEARYIMSRIDSTSDDLVNKTLLNFAKLDFNILLDLHKEELNELTKWWQDLDFTTKLPYARDRLVELYFWDLGTYFEPQYAFGRKIMTKLNYILSIIDDTYDAYGTLEELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSTEEAIKMFEEEVANAWKDINEELMMKPPVVARPLLGTILNLARAIDFIYKEDDGYTHSYLIKEQIASVLGDHVPF

SEQ ID NO: 730 - protein, 548 aa, Artificial Sequence
  CVS mutant V202
MSSGETFRPTADFHPSLWRNHFLQGASDFKTVDHTATNERHEALKEEVRRMITDAEDQPIQKLRLIDEVQRLGVAYHFEKEIEDAIQQLCPIHIDSDKADLHTVSLHFRLLRQQGIKISCDVFEQFKDDEGRFKSSLINDVQGMLSLYEAAYMAVRGEHILDEAIAFTTTHLQSLVAQDHVTPRLAEQINHALYRPLRKTLPRLEARYIMSRIDSTSDALVNKTLLNFAKLDFNILLDLHKEELNELTKWWQDLDFTTKLPYARDRLVELYFWDLGTYFEPQYAFGRKIMTKLNYILSIIDDTYDAYGTLEELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 731 - protein, 546 aa, Artificial Sequence
  CVS mutant V208
MSSGETFRPTADFHPSLWRNHFLQGASDFKTVDHTATNERHEALKEEVRRMILPRFSQPIQKLRLIDEVQRLGVAYHFEKEIEDAIQQLCPIHIDSDKADLHTVSLHFRLLRQQGIKISCDVFEQFKDDEGRFKSSLINDVQGMLSLYEAAYMAVRGEHILDEAIAFTTTHLQSLVAQDHVTPRLAEQINHALYRPLRKTLPRLEARYIMSRIDSTSDDLVNKTLLNFAKLDFNILLDLHKEELNELTKWWQDLDFTTKLPYARDRLVELYFWDLGTYFEPQYAFGRKIMTKLNYILSIIDDTYDAYGTLEELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 732 - protein, 546 aa, Artificial Sequence
  CVS mutants V232, V233, V234, V235 and V236
MSSGETFRPTADFHPSLWRNHFLQGASDFKTVDHTATNERHEALKEEVRRMITDAEDQPIQKLRLIDEVQRLGVAYHFEKEIEDAIQQLCPIHIDSDKADLHTVSLHFRLLRQQGIKISCDVFEQFKDDEGRFKSSLINDVQGMLSLYEAAYMAVRGEHILDEAIAFTTTHLQSAAPHLKSPLAEQINHALYRPLRKTLPRLEARYIMSRIDSTSDDLVNKTLLNFAKLDFNILLDLHKEELNELTKWWQDLDFTTKLPYARDRLVELYFWDLGTYFESQYAFGRKIMTKLNYILSIIDDTYDAYGTLEECTMFSEAVARWNIEAVDMLPDYMRIIYRTLLDTFNEIEEDMAKQRRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 733 - protein, 546 aa, Artificial Sequence
  CVS mutants V237 and V238
MRDKGTCRPTADFHPSLWRNHFLQGASDFKTVDHTATNERHEALKEEVRRMITDAEDQPIQKLRLIDEVQRLGVAYHFEKEIEDAIQQLCPIHIDSDKADLHTVSLHFRLLRQQGIKISCDVFEQFKDDEGRFKSSLINDVQGMLSLYEAAYMAVRGEHILDEAIAFTTTHLQSAAPHLKSPLAEQINHALYRPLRKTLPRLEARYIMSRIDSTSDDLVNKTLLNFAKLDFNILLDLHKEELNELTKWWQDLDFTTKLPYARDRLVELYFWDLGTYFESQYAFGRKIMTKLNYILSIIDDTYDAYGTLEECTMFSEAVARWNIEAVDMLPDYMRIIYRTLLDTFNEIEEDMAKQRRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEDVANAWKDINEELMMKPPVVARPLLGTILNLARAIDFIYKEDDGYTHSYLIKEQIASVLGDHVPF

SEQ ID NO: 734 - protein, 548 aa, Artificial Sequence
  CVS mutant V209
MSSGETFRPTADFHPSLWRNHFLQGASDFKTVDHTATNERHEALKEEVRRMITAVAQPPIQKLRLIDEVQRLGVAYHFEKEIEDAIQQLCPIHIDSDKADLHTVSFHFRLLRQQGIKISCDVFEQFKDDEGRFKSSLINDVQGMLSLYEAAYMAVRGEHILDEAIAFTTTHLQSLVAQDHVTPRLAEQINHALYRPLRKTLPRLEARYIMSRIDSTSDDLVNKTLLNFAKLDFNILLDLHKEELNELTKWWQDLDFTTKLPYARDRLVELYFWDLGTYFEPQYAFGRKIMTKLNYILSIIDDTYDAYGTLEELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 735 - protein, 548 aa, Artificial Sequence
  CVS mutant V210
MSSGETFRPTADFHPSLWRNHFLQGASDFKTVDHTATNERHEALKEEVRRMIRAQTARPIQKLRLIDEVQRLGVAYHFEKEIEDAIQQLCPIHIDSDKADLHTVSLHFRLLRQQGIKISCDVFEQFKDDEGRFKSSLINDVQGMLSLYEAAYMAVRGEHILDEAIAFTTTHLQSLVAQDHVTPRLAEQINHALYRPLRKTLPRLEARYIMSRIDSTSDDLVNKTLLNFAKLDFNILLDLHKEELNELTKWWQDLDFTTKLPYARDRLVELYFWDLGTYFEPQYAFGRKIMTKLNYILSIIDDTYDAYGTLEELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 736 - protein, 548 aa, Artificial Sequence
  CVS mutant V211
MSSGETFRPTADFHPSLWRNHFLQGASDFKTVDHTATNERHEALKEEVRRMIRCVQPEPIQKLRLIDEVQRLGVAYHFEKEIEDAIQQLCPIHIDSDKADLHTVSLHFRLLRQQGIKISCDVFEQFKDDEGRFKSSLINDVQGMLSLYEAAYMAVRGEHILDEAIAFTTTHLQSLVAQDHVTPRLAEQINHALYRPLRKTLPRLEARYIMSRIDSTSDDLVNKTLLNFAKLDFNILLDLHKEELNELTKWWQDLDFTTKLPYARDRLVELYFWDLGTYFEPQYAFGRKIMTKLNYILSIIDDTYDAYGTLEELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 737 - protein, 548 aa, Artificial Sequence
  CVS mutant V212
MSSGETFRPTADFHPSLWRNHFLQGASDFKTVDHTATNERHEALKEEVRRMITDAEDQPIQKLRLIDEVQRLGVAYHFEKEIEDAIQQLCPIHIDSDKADLHTVSLHFRLLRQQGIKISCDVFEQFKDDEGGFKSSLINDVQGMLSLYEAAYMAVRGEHILDEAIAFTTTHLQSLVAQDHVTPRLAEQINHALYRPLRKTLPRLEARYIMSRIDSTSDDLVNKTLLNFAKLDFNILLDLHKEELNELTKWWQDLDFTTKLPYARDRLVELYFWDLGTYFEPQYAFGRKIMTKLNYILSIIDDTYDAYGTLEELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 738 - protein, 548 aa, Artificial Sequence
  CVS mutant V213
MSSGETFRPTADFHPSLWRNHFLQGASDFKTVDHTATNERHEALKEEVRRMITDAEDQPIQKLRLIDEVQRLGVAYHFEKEIEDAIQQLCPIHIDSDKADLHTVSLHFRLLRQQGIKISCDVFEQFKDDEGRFKSSLINDVQGMLSLYEAAYMAVRGEQILDEAIAFTTTHLQSLVAQDHVTPRLAEQINHALYRPLRKTLPRLEARYIMSRIDSTSDDLVNKTLLNFAKLDFNILLDLHKEELNELTKWWQDLDFTTKLPYARDRLVELYFWDLGTYFEPQYAFGRKIMTKLNYILSIIDDTYDAYGTLEELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 739 - protein, 548 aa, Artificial Sequence
  CVS mutant V214
MSSGETFRPTADFHPSLWRNHFLQGASDFKTVDHTATNERHEALKEEVRRMITDAEDQPIQKLRLIDEVQRLGVAYHFEKEIEDAIQQLCPIHIDSDKADLHTVSLHFRLLRQQGIKISCDVFEQFKDDEGRFKSSLINDVQGMLSLYEAAYGAVRGEHILDEAIAFTTTHLQSLVAQDHVTPRLAEQINHALYRPLRKTLPRLEARYIMSRIDSTSDDLVNKTLLNFAKLDFNILLDLHKEELNELTKWWQDLDFTTKLPYARDRLVELYFWDLGTYFEPQYAFGRKIMTKLNYILSIIDDTYDAYGTLEELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 740 - protein, 548 aa, Artificial Sequence
  CVS mutant V215
MSSGETFRPTADFHPSLWRNHFLQGASDFKTVDHTATNERHEALKEEVRRMITDAEDQPIQKLRLIDEVQRLGVAYHFEKEIEDAIQQLCPIHIDSDKADLHTVSLHFRLLRQQGIKISCDVFEQFKDDEGRFKSSLINDVQGMLSLYEAAYMAVRGEHILDEAIAFTTTHLQSLVAQDHVTPRLAEQINHALYRPLRKTLPRLEARYIMSRIDSTSDDLVNKTLLNFAKLDFNILLDLHKEELNELTKWWQDLDFTTKLPYARDRLVELYFWDLGTYFEPQYAFGRKIMTKLNYILSIIDDTYDAYGTLEELSLFTEAVARWNIEAVDMLPDYMKLIYRTLLDTFNEIEEDMAKQGRSHCVRYAKEEIQKVIGAYYVQAKWFSEGYVPTIEEYMPVALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 741 - protein, 548 aa, Artificial Sequence; identical to SEQ ID NO: 4
  CVS mutant V216

SEQ ID NO: 742 - protein, 544 aa, Artificial Sequence
  CVS mutant V217 (AA5-548)
ETFRPTADFHPSLWRNHFLQGASDFKTVDHTATNERHEALKEEVRRMITDAEDQPIQKLRLIDEVQRLGVAYHFEKEIEDAIQQLCPIHIDSDKADLHTVSLHFRLLRQQGIKISCDVFEQFKDDEGRFKSSLINDVQGMLSLYEAAYMAVRGEHILDEAIAFTTTHLQSLVAQDHVTPRLAEQANHALYRPLRKTLPRLEARYIMSRIDSTSDDLVNKTLLNFAKLDFNILLDLHKEELNELTKWWQDLDFTTKLPYARDRLVELYFWDLGTYFEPQYAFGRKIMTKLNYILSIIDDTYDAYGTLEELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 743 - protein, 549 aa, Artificial Sequence
  CVS mutant V239
MSSGETFRPTADFHPSLWRNHFLQGASDFKTVDHTATNERHEALKEEVRRMILATGRKPIQKLRLIDEVQRLGVAYHFEKEIEDMLDHIYRADPYFEAHEYNDLHTVSLHFRLSRQQGIKISCDVFEQFKDDEGRFKSSLINDVQGMLSLYEAAYMAVRGEHILDEAIAFTTTHLQSAAPHLKSPLAEQINHALYRPLRKTLPRLEARYIMSRIDSTSDDLVNKTLLNFAKLDFNILLDLHKEELNELTKWWQDLDFTTKLPYARDRLVELYFWDLGTYFESQYAFGRKIMTKLNYILSIIDDTYDAYGTLEECTMFSEAVARWNIEAVDMLPDYMRIIYRTLLDTFNEIEEDMAKQRRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEDVANAWKDINEELMMKPPVVARPLLGTILNLARAIDFIYKEDDGYTHSYLIKEQIASVLGDHVPF

SEQ ID NO: 744 - protein, 549 aa, Artificial Sequence
  CVS mutant V240
MSSGETFRPTADFHPSLWKNHFLQGASDFKTVDHTATNERHEALKEEVRRMILATGRKPIQKLRLIDEVQRLGVAYHFEKEIEDMLDHIYRADPYFEAHEYNDLHTVSLHFRLLRQQGIKISCDVFEQFKDDEGRFKSSLINDVQGMLSLYEAAYMAVRGEHILDEAIAFTTTHLQSAAPHLKSPLAEQINHALYRPLRKTLPRLEARYIMSRIDSTSDDLVNKTLLNFAKLDFNILLDLHKEELNELTKWWQDLDFTTKLPYARDRLVELYFWDLGTYFESQYAFGRKIMTKLNYILSIIDDTYDAYGTLEECTMFSEAVARWNIEAVDMLPDYMRIIYRTLLDTFNEIEEDMAKQRRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEDVANAWKDINEELMMKPPVVARPLLGTILNLARAIDFIYKEDDGYTHSYLIKEQIASVLGDHVPF

SEQ ID NO: 745 - protein, 549 aa, Artificial Sequence
  CVS mutant V242
  VARIANT 62: Xaa = Lys or Arg
MSSGETFRPTADFHPSLWRNHFLQGASDFKTVDHTATNERHEALKEEVRRMILATGRKPIQXLRLIDEVQRLGVAYHFEKEIEDMLDHIYRADPYFEAHEYNDLHTVSLHFRLLRQQGIKISCDVFEQFKDDEGRFKSSLINDVQGMLSLYEAAYMAVRGEHILDEAIAFTTTHLQSAAPHLKSPLAEQINHALYRPLRKTLPRLEARYIMSRIDSTSDDLVNKTLLNFAKLDFNILLDLHKEELNELTKWWQDLDFTTKLPYARDRLVELYFWDLGTYFESQYAFGRKIMTKLNYILSIIDDTYDAYGTLEECTMFSEAVARWNIEAVDMLPDYMRIIYRTLLDTFNEIEEDMAKQRRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEDVANAWKDINEELMMKPPVVARPLLGTILNLARAIDFIYKEDDGYTHSYLIKEQIASVLGDHVPF

SEQ ID NO: 746 - protein, 548 aa, Artificial Sequence
  CVS mutant V218 and V219
MSSGETFRPTADFHPSLWRNHFLQGASDFKTVDHTATNERHEALKEEVRRMITDAEDQPIQKLRLIDEVQRLGVAYHFEKEIEDAIQQLCPIHIDSDKADLHTVSLHFRLLRQQGIKISCDVFEQFKDDEGRFKSSLINDVQGMLSLYEAAYMAVRGEHILDEAIAFTTTHLQSLVAQDHVTPRLAEQINHALYRPLRKTLPRLEARYIMSRIDSTSDDLVNKTLLNFAKLDFNILLDLHKEELNELTKWWQDLDFTTKLPYARDRLVELYFWDLGTYFEPQYAFGRKIMTKLNYILSIIDDTYDAYGTHPELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 747 - protein, 548 aa, Artificial Sequence
  CVS mutant V220
MSSGETFRPTADFHPSLWRNHFLQGASDFKTVDHTATNERHEALKEEVRRMITDAEDQPIQKLRLIDEVQRLGVAYHFEKEIEDAIQQLCPIHIDSDKADLHTVSLHFRLLRQQGIKISCDVFEQFKDDEGRFKSSLINDVQGMLSLYEAAYMAVRGEHILDEAIAFTTTHLQSLVAQDHVTPRLAEQINHALYRPLRKTLPRLEARYIMSNYLRRIPADSNKTLLNFAKLDFNILLDLHKEELNELTKWWQDLDFTTKLPYARDRLVELYFWDLGTYFESQYAFGRKIMTKLNYILSIIDDTYDAYGTLEECTMFSEAVARWNIEAVDMLPDYMRIIYRTLLDTFNEIEEDMAKQRRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 748 - protein, 548 aa, Artificial Sequence
  CVS mutant V221
MSSGETFRPTADFHPSLWRNHFLQGASDFKTVDHTATNERHEALKEEVRRMITDAEDQPIQKLRLIDEVQRLGVAYHFEKEIEDAIQQLCPIHIDSDKADLHTVSLHFRLLRRQGIKISCDVFEQFKDDEGRFKSSLINDVQGMLSLYEAAYMAVRGEHILDEAIAFTTTHLQSLVAQDHVTPRLAEQINHALYRPLRKTLPRLEARYIMSDYEHQSILVQNKTLLNFAKLDFNILLDLHKEELNELTKWWQDLDFTTKLPYARDRLVELYFWDLGTYFESQYAFGRKIMTKLNYILSIIDDTYDAYGTLEECTMFSEAVARWNIEAVDMLPDYMRIIYRTLLDTFNEIEEDMAKQRRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 749 - protein, 548 aa, Artificial Sequence
  CVS mutant V224
MSSGETFRPTADFHPSLWRNHFLQGASDFKTVDHTATNERHEALKEEVRRMITDAEDQPIQKLRLIDEVQRLGVAYHFEKEIEDAIQQLCPIHIDSDKADLHTVSLHFRLLRQQGIKISCDVFEQFKDDEGRFKSSLINDVQGMLSLYEAAYMAVRGEHILDEAIAFTTTHLQSLVAQDHVTPRLAEQINHALYRPLRKTLPRLEARYIMSNMSSYRGCSVNKTLLNFAKLDFNILLDLHKEELNELTKWWQDLDFTTKLPYARDRLVELYFWDLGTYFESQYAFGRKIMTKLNYILSIIDDTYDAYGTLEECTMFSETVARWNIEAVDMLPDYMRIIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 750 - protein, 548 aa, Artificial Sequence
  CVS mutant V225
MSSGETFRPTADFHPSLWRNHFLQGASDFKTVDHTATNERHEALKEEVRRMITDAEDQPIQKLRLIDEVQRLGVAYHFEKEIEDAIQQLCPIHIDSDKADLHTVSLHFRLLRQQGIKISCDVFEQFKDDEGRFKSSLINDVQGMLSLYEAAYMAVRGEHILDEAIAFTTTHLQSLVAQDHVTPRLAEQINHALYRPLRKTLPRLEARYIMSDANGEKVLSFNKTLLNFAKLDFNILLDLHKEELNELTKWWQDLDFTTKLPYARDRLVELYFWDLGTYFESQYAFGRKIMTKLNYILSIIDDTYDAYGTLEECTMFSEAVARWNIEAVDMLPDYMRIIYRTLLDTFNEIEEDMAKQRRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 751 - protein, 548 aa, Artificial Sequence
  CVS mutant V226
MSSGETFRPTADFHPSLWRNHFLQGASDFKTVDHTATNERHEALKEEVRRMITDAEDQPIQKLRLIDEVQRLGVAYHFEKEIEDAIQQLCPIHIDSDKADLHTVSLHFRLLRQQGIKISCDVFEQFKDDEGRFKSSLINDVQGMLSLYEAAYMAVRGEHILDEAIAFTTTHLQSLVAQDHVTPRLAEQINHALYRPLRKTLPRLEARYIMSSRSKPFCWTSNKTLLNFAKLDFNILLDLHKEELNELTKWWQDLDFTTKLPYARDRLVELYFWDLGTYFEPQYAFGRKIMTKLNYILSIIDDTYDAYGTLEELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 752 - protein, 548 aa, Citrus paradisi
  Citrus valencene synthase
MSSGETFRPTADFHPSLWRNHFLKGASDFKTVDHTATQERHEALKEEVRRMITDAEDKPVQKLRLIDEVQRLGVAYHFEKEIEDAIQKLCPNYIHSNSPDLHTVSLHFRLLRQQGIKISCDVFEKFKDDEGRFKSSLINDVQGMLSLYEAAYMAVRGEHILDEAIAFTTTHLKSLVAQDHVTPKLAEQINHALYRPLRKTLPRLEARYFMSMINSTSDHLYNKTLLNFAKLDFNILLELHKEELNELTKWWKDLDFTTKLPYARDRLVELYFWDLGTYFEPQYAFGRKIMTQLNYILSIIDDTYDAYGTLEELSLFTEAVQRWNIEAVDMLPEYMKLIYRTLLDAFNEIEEDMAKQGRSHCVRYAKEENQKVIGAYSVQAKWFSEGYVPTIEEYMPIALTSCAYTFVITNSFLGMGDFATKEVFEWISNNPKVVKAASVICRLMDDMQGHEFEQKRGHVASAIECYTKQHGVSKEEAIKMFEEEVANAWKDINEELMMKPTVVARPLLGTILNLARAIDFIYKEDDGYTHSYLIKDQIASVLGDHVPF

SEQ ID NO: 753 - DNA, 1647 bp, Citrus paradisi
  Citrus valencene synthase
atgtcgtctggagaaacatttcgtcctactgcagatttccatcctagtttatggagaaaccatttcctcaaaggtgcttctgatttcaagacagttgatcatactgcaactcaagaacgacacgaggcactgaaagaagaggtaaggagaatgataacagatgctgaagataagcctgttcagaagttacgcttgattgatgaagtacaacgcctgggggtggcttatcactttgagaaagaaatagaagatgcaatacaaaaattatgtccaaactatattcacagtaatagccctgatcttcacaccgtttctcttcattttcgattgcttaggcagcaaggaatcaagatttcatgtgatgtgtttgagaagttcaaagatgatgagggtagattcaagtcatcgttgataaacgatgttcaagggatgttaagtttgtacgaggcagcatacatggcagttcgcggagaacatatattagatgaagccattgctttcactaccactcacctgaagtcattggtagctcaggatcatgtaacccctaagcttgcggaacagataaatcatgctttataccgtcctcttcgtaaaaccctaccaagattagaggcgaggtattttatgtccatgatcaattcaacaagtgatcatttatacaataaaactctgctgaattttgcaaagttagattttaacatattgctagagctgcacaaggaggaactcaatgaattaacaaagtggtggaaagatttagacttcactacaaaactaccttatgcaagagacagattagtggagttatatttttgggatttagggacatacttcgagcctcaatatgcatttgggagaaagataatgacccaattaaattacatattatccatcatagatgatacttatgatgcgtatggtacacttgaagaactcagcctctttactgaagcagttcaaagatggaatattgaggccgtagatatgcttccagaatacatgaaattgatttacaggacactcttagatgcttttaatgaaattgaggaagatatggccaagcaaggaagatcacactgcgtacgttatgcaaaagaggagaatcaaaaagtaattggagcatactctgttcaagccaaatggttcagtgaaggttacgttccaacaattgaggagtatatgcctattgcactaacaagttgtgcttacacattcgtcataacaaattccttccttggcatgggtgattttgcaactaaagaggtttttgaatggatctccaataaccctaaggttgtaaaagcagcatcagttatctgcagactcatggatgacatgcaaggtcatgagtttgagcagaagagaggacatgttgcgtcagctattgaatgttacacgaagcagcatggtgtctctaaggaagaggcaattaaaatgtttgaagaagaagttgcaaatgcatggaaagatattaacgaggagttgatgatgaagccaaccgtcgttgcccgaccactgctcgggacgattcttaatcttgctcgtgcaattgattttatttacaaagaggacgacggctatacgcattcttacctaattaaagatcaaattgcttctgtgctaggagaccacgttccattttga

SEQ ID NO: 754 - DNA, 1647 bp, Artificial Sequence
  CVS mutant V179
atgtcatctggtgaaacttttagaccaactgctgattttcatccatctttgtggagaaatcattttttgcaaggtgcatcagattttaagactgttgatcatacagctacaaatgaaagacatgaagctttgaaggaagaagttagaagaatgattactgatgcagaagatcaaccaattcaaaaattgagattgattgatgaagttcaaagattgggtgttgcttaccattttgaaaaagaaattgaagatgctattcaacaattgtgtccaattcatattgattctgataaagctgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttggggacttattttgaatcatcttacgcttttggtagaaaaatcatgactaaattgaactacattttgtccattattgatgatacctacgatgcttacggtactttgcctgaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 755 - DNA, 1350 bp, Artificial Sequence
  CVS mutant V180 (encoding AA 100-548)
gatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttggggacttattttgaatcatcttacgcttttggtagaaaaatcatgactaaattgaactacattttgtccattattgatgatacctacgatgcttacggtactcacgaagaattgtctttgttcaccaaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 756 - DNA, 1485 bp, Artificial Sequence
  CVS mutant V181 (encoding AA 55-548)
gcagaagatcaaccaattcaaaaattgagattgattgatgaagttcaaagattgggtgttgcttaccattttgaaaaagaaattgaagatgctattcaacaattgtgtccaattcatattgattctgataaagctgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttggggacttattttgaatcatcttacgcttttggtagaaaaatcatgactaaattgaactacattttgtccattattgatgatacctacgatgcttacggtactcacgaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 757 - DNA, 1647 bp, Artificial Sequence
  CVS mutant V184
atgtcatctggtgaaacttttagaccaactgctgattttcatccatctttgtggagaaatcattttttgcaaggtgcatcagattttaagactgttgatcatacagctacaaatgaaagacatgaagctttgaaggaagaagttagaagaatgattactgatgcagaagatcaaccaattcaaaaattgagattgattgatgaagttcaaagattgggtgttgcttaccattttgaaaaagaaattgaagatgctattcaacaattgtgtccaattcatattgattctgataaagctgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttgggtacttattttgaaccacaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctctttgtgtaagatacgctaaagaagaaattcacaaggttattggtgactattacgttcaagctaagtggttttctgaaggttatgtccctactattgaagaatacatgccaattgctttgacttcttgcgcttacagatttgttattggcaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaaggattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 758 - DNA, 1647 bp, Artificial Sequence
  CVS mutant V186
atgccgcgtcgggatagggcgagaccaactgctgattttcatccatctttgtggagaaatcattttttgcaaggtgcatcagattttaagactgttgatcatacagctacaaatgaaagacatgaagctttgaaggaagaagttagaagaatgattactgatgcagaagatcaaccaattcaaaaattgagattgattgatgaagttcaaagattgggtgttgcttaccattttgaaaaagaaattgaagatgctattcaacaattgtgtccaattcatattgattctgataaagctgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttgggtacttattttgaaccacaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 759 - DNA, 1647 bp, Artificial Sequence
  CVS mutant V187
atgtctttatcacatgacagtagaccaactgctgattttcatccatctttgtggagaaatcattttttgcaaggtgcatcagattttaagactgttgatcatacagctacaaatgaaagacatgaagctttgaaggaagaagttagaagaatgattactgatgcagaagatcaaccaattcaaaaattgagattgattgatgaagttcaaagattgggtgttgcttaccattttgaaaaagaaattgaagatgctattcaacaattgtgtccaattcatattgattctgataaagctgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttgggtacttattttgaaccacaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 760 - DNA, 1647 bp, Artificial Sequence
  CVS mutant V188
atgacgcgaggtatcctcaaaagaccaactgctgattttcatccatctttgtggagaaatcattttttgcaaggtgcatcagattttaagactgttgatcatacagctacaaatgaaagacatgaagctttgaaggaagaagttagaagaatgattactgatgcagaagatcaaccaattcaaaaattgagattgattgatgaagttcaaagattgggtgttgcttaccattttgaaaaagaaattgaagatgctattcaacaattgtgtccaattcatattgattctgataaagctgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttgggtacttattttgaaccacaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 761 - DNA, 1647 bp, Artificial Sequence
  CVS mutant V189
atgttagatagtatcgcagggagaccaactgctgattttcatccatctttgtggagaaatcattttttgcaaggtgcatcagattttaagactgttgatcatacagctacaaatgaaagacatgaagctttgaaggaagaagttagaagaatgattactgatgcagaagatcaaccaattcaaaaattgagattgattgatgaagttcaaagattgggtgttgcttaccattttgaaaaagaaattgaagatgctattcaacaattgtgtccaattcatattgattctgataaagctgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttgggtacttattttgaaccacaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 762 - DNA, 1647 bp, Artificial Sequence
  CVS mutant V190
atgcatgagccctctgagactagaccaactgctgattttcatccatctttgtggagaaatcattttttgcaaggtgcatcagattttaagactgttgatcatacagctacaaatgaaagacatgaagctttgaaggaagaagttagaagaatgattactgatgcagaagatcaaccaattcaaaaattgagattgattgatgaagttcaaagattgggtgttgcttaccattttgaaaaagaaattgaagatgctattcaacaattgtgtccaattcatattgattctgataaagctgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttgggtacttattttgaaccacaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 763 - DNA, 1647 bp, Artificial Sequence
  CVS mutant V191
atgctaggcgtttctgaacaaagaccaactgctgattttcatccatctttgtggagaaatcattttttgcaaggtgcatcagattttaagactgttgatcatacagctacaaatgaaagacatgaagctttgaaggaagaagttagaagaatgattactgatgcagaagatcaaccaattcaaaaattgagattgattgatgaagttcaaagattgggtgttgcttaccattttgaaaaagaaattgaagatgctattcaacaattgtgtccaattcatattgattctgataaagctgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttgggtacttattttgaaccacaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 764 - DNA, 1647 bp, Artificial Sequence
  CVS mutant V192
atgcgggtggcgcctaaattcagaccaactgctgattttcatccatctttgtggagaaatcattttttgcaaggtgcatcagattttaagactgttgatcatacagctacaaatgaaagacatgaagctttgaaggaagaagttagaagaatgattactgatgcagaagatcaaccaattcaaaaattgagattgattgatgaagttcaaagattgggtgttgcttaccattttgaaaaagaaattgaagatgctattcaacaattgtgtccaattcatattgattctgataaagctgatttgcatactgtttctttgcatttcagattgttgagacaacaaggtattaagatttcttgtgatgttttcgaacaatttaaggatgatgaaggaagattcaaaagttctttgattaatgatgttcaaggcatgttgtctttgtatgaagctgcttatatggctgttagaggtgaacatattttggatgaagctattgcatttactactactcatttgcaatcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttgggtacttattttgaaccacaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggcgatcatgttccattttaa

SEQ ID NO: 765 - DNA, 1647 bp, Artificial Sequence
  CVS mutant V193
atgagagctgaactgagccttagaccaactgctgattttcatccatctttgtggagaaatcattttttgcaaggtgcatcagattttaagactgttgatcatacagctacaaatgaaagacatgaagctttgaaggaagaagttagaagaatgattactgatgcagaagatcaaccaattcaaaaattgagattgattgatgaagttcaaagattgggtgttgcttaccattttgaaaaagaaattgaagatgctattcaacaattgtgtccaattcatattgattctgataaagctgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttgggtacttattttgaaccacaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 766 - DNA, 1647 bp, Artificial Sequence
  CVS mutant V195
atgagggtgattgatggcgggagaccaactgctgattttcatccatctttgtggagaaatcattttttgcaaggtgcatcagattttaagactgttgatcatacagctacaaatgaaagacatgaagctttgaaggaagaagttagaagaatgattactgatgcagaagatcaaccaattcaaaaattgagattgattgatgaagttcaaagattgggtgttgcttaccattttgaaaaagaaattgaagatgctattcaacaattgtgtccaattcatattgattctgataaagctgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttgggtacttattttgaaccacaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 767 - DNA, 1647 bp, Artificial Sequence
  CVS mutant V199
atgtcatctggtgaaacttttagaccaactgctgattttcatccatctttgtggagaaatcattttttgcaaggtgcatcagattttaagactgttgatcatacagctacaaatgaaagacatgaagctttgaaggaagaagttagaagaatgattctagccccaccgccccgcccaattcaaaaattgagattgattgatgaagttcaaagattgggtgttgcttaccattttgaaaaagaaattgaagatgctattcaacaattgtgtccaattcatattgattctgataaagctgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttgggtacttattttgaaccacaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 768 - DNA, 1647 bp, Artificial Sequence
  CVS mutant V201
atgtcatctggtgaaacttttagaccaactgctgattttcatccatctttgtggagaaatcattttttgcaaggtgcatcagattttaagactgttgatcatacagctacaaatgaaagacatgaagctttgaaggaagaagttagaagaatgattactgatgcagaagatcaaccaattcaaaaattgagattgattgatgaagttcaaagattgggtgttgcttaccattttgaaaaagaaattgaagatgctattcaacaattgtgtccaattcatattgattctgataaagctgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatcattggttgcacaagatcatgttactccaagattggctgaacaaattaaccatgctttgtatagaccattgagaaaaactttgccaagattggaagcaagatacattatgtcaagatcggattctacttctgatgatttggttaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttgggtacttattttgaaccacaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 769 - DNA, 1647 bp, Artificial Sequence
  CVS mutant V203
atgtcatctggtgaaacttttagaccaactgctgattttcatccatctttgtggagaaatcattttttgcaaggtgcatcagattttaagactgttgatcatacagctacaaatgaaagacatgaagctttgaaggaagaagttagaagaatgattactgatgcagaagatcaaccaattcaaaaattgagattgattgatgaagttcaaagattgggtgttgcttaccattttgaaaaagaaattgaagatgctattcaacaattgtgtccaattcatattgattctgataaagctgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatcattggttgcacaagatcatgttactccaagattggctgaacgagttaaccatgctttgtatagaccattgagaaaaactttgtcaagattggaagcaagatacattatgtcaagaattgattctacttctgatgatttggttaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttgggtacttattttgaaccacaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggcgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaggaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 770 - DNA, 1647 bp, Artificial Sequence; identical to SEQ ID NO: 699
  CVS mutant V204

SEQ ID NO: 771 - DNA, 1647 bp, Artificial Sequence
  CVS mutant V205
atgtcatctggtgaaacttttagaccaactgctgattttcatccatctttgtggagaaatcattttttgcaaggtgcatcagattttaagactgttgatcatacagctacaaatgaaagacatgaagctttgaaggaagaagttagaagaatgattactgatgcagaagatcaaccaattcaaaaattgagattgattgatgaagttcaaagattgggtgttgcttaccattttgaaaaagaaattgaagatgctattcaacaattgtgtccaattcatattgattctgataaagctgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacgcattttggatgaagctattgcatttactactactcatttgcaatcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttgggtacttattttgaaccacaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 772 - DNA, 1647 bp, Artificial Sequence
  CVS mutant V206
atgtcatctggtgaaacttttagaccaactgctgattttcatccatctttgtggagaaatcattttttgcaaggtgcatcagattttaagactgttgatcatacagctacaaatgaaagacatgaagctttgaaggaagaagttagaagaatgattactgatgcagaagatcaaccaattcaaaaattgagattgattgatgaagttcaaagattgggtgttgcttaccattttgaaaaagaaattgaagatgctattcaacaattgtgtccaattcatattgattctgataaagctgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaaaaaattttggatgaagctattgcatttactactactcatttgcaatcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttgggtacttattttgaaccacaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 773 - DNA, 1647 bp, Artificial Sequence
  CVS mutant V207
atgtcatctggtgaaacttttagaccaactgctgattttcatccatctttgtggagaaatcattttttgcaaggtgcatcagattttaagactgttgatcatacagctacaaatgaaagacatgaagctttgaaggaagaagttagaagaatgattactgatgcagaagatcaaccaattcaaaaattgagattgattgatgaagttcaaagattgggtgttgcttaccattttgaaaaagaaattgaagatgctattcaacaattgtgtccaattcatattgattctgataaagctgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatcattggttgcacaagatcatgttactccaagattggctgaacaacccaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttgggtacttattttgaaccacaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 774 - DNA, 1647 bp, Artificial Sequence
  CVS mutant V222
atgtcatctggtgaaacttttagaccaactgctgattttcatccatctttgtggagaaatcattttttgcaaggtgcatcagattttaagactgttgatcatacagctacaaatgaaagacatgaagctttgaaggaagaagttagaagaatgattactgatgcagaagatcaaccaattcaaaaattgagattgattgatgaagttcaaagattgggtgttgcttaccattttgaaaaagaaattgaagatgctattcaacaattgtgtccaattcatattgattctgataaagctgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatcattggttgcacaagatcatgttactccaagattggctgaacaaattaaccatgctttgtatagaccattgagaaaaactttgccaagattggaagcaagatacattatgtcatccctggaacctcccttcatgcacccctgcaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttgggtacttattttgaaccacaatacgcttttggtagaaaaatcatgactaaattgaactacattttgtccattattgatgatacctacgatgcttacggtactttggaagaatgcacgatgttcagtgaagctgttgctcgttggaacattgaagctgttgatatgttgccagattatatgcgaattatctacagaactttgttggatacattcaacgaaatagaagaggatatggctaaacaacggagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 775 - DNA, 1647 bp, Artificial Sequence
  CVS mutant V223
atgtcatctggtgaaacttttagaccaactgctgattttcatccatctttgtggagaaatcattttttgcaaggtgcatcagattttaagactgttgatcatacagctacaaatgaaagacatgaagctttgaaggaagaagttagaagaatgattactgatgcagaagatcaaccaattcaaaaattgagattgattgatgaagttcaaagattgggtgttgcttaccattttgaaaaagaaattgaagatgctattcaacaattgtgtccaattcatattgattctgataaagctgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaggctattgcatttactactactcatttgcaatcattggttgcacaagatcatgttactccaagattggctgaacaaattaaccatgctttgtatagaccattgagaaaaactttgccaagattggaagcaagatacattatgtcagcgatctatgcaaggacaggacgcatgaacaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttgggtacttattttgaaccacaatacgcttttggtagaaaaatcatgactaaattgaactacattttgtccattattgatgatacctacgatgcttacggtactttggaagaatgcacgatgttcagtgaagctgttgctcgttggaacattgaagctgttgatatgttgccagattatatgcgaattatctacagaactttgttggatacattcaacgaaatagaagaggatatggctaaacaacggagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 776 - DNA, 1641 bp, Artificial Sequence
  CVS mutant V242
atgtcatctggtgaaacttttagaccaactgctgattttcatccatctttgtggagaaatcattttttgcaaggtgcatcagattttaagactgttgatcatacagctacaaatgaaagacatgaagctttgaaggaagaagttagaagaatgattactgatgcagaagatcaaccaattcaaaaattgagattgattgatgaagttcaaagattgggtgttgcttaccattttgaaaaagaaattgaagatgctattcaacaattgtgtccaattcatattgattctgataaagctgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatcattggttgcacaagatcatgttactccaagattggctgaacaaattaaccatgctttgtatagaccattgagaaaaactttgccaagattggaagcaagatacattatgtcaatctacgaagaggagggatttaagaataagactttgttaaatttcgctaagttggatttcaatattttgttggatttgcataaagaagaattgaacgaattgactaaatggtggcaagatttggattttactactaaattgccatatgctagagatagattggttgaattgtacttttgggatttggggacttattttgaatcacaatacgcttttggtagaaaaatcatgactaaattgaactacattttgtccattattgatgatacctacgatgcttacggtactttggaagaatgcacgatgttcagtgaagctgttgctcgttggaacattgaagctgttgatatgttgccagattatatgcgaattatctacagaactttgttggatacattcaacgaaatagaagaggatatggctaaacaacggagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 777 - DNA, 1647 bp, Artificial Sequence
  CVS mutant V243
atgtcatctggtgaaacttttagaccaactgctgattttcatccatctttgtggaaaaatcattttttgcaaggtgcatcagattttaagactgttgatcatacagctacaaatgaaagacatgaagctttgaaggaagaagttagaagaatgattttagcaaccggaaggaaaccaattcaaaaattgagattgattgatgaagttcaaagattgggtgttgcttaccattttgaaaaagaaattgaagatatgttggatcacatttacagagctgatccttattttgaggctcatgaatacaatgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatctgcagctccacatttgaagtcacctttggctgaacaaattaaccatgctttgtatagaccattgagaaaaactttgccaagattggaagcaagatacattatgtcatcaatctatgacaaggaacaatcgaagaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttggggacttattttgaatcacaatacgcttttggtagaaaaatcatgactaaattgaactacattttgtccattattgatgatacctacgatgcttacggtactttggaagaatgcacgatgttcagtgaagctgttgctcgttggaacattgaagctgttgatatgttgccagattatatgcgaattatctacagaactttgttggatacattcaacgaaatagaagaggatatggctaaacaacggagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagatgttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 778 - DNA, 1647 bp, Artificial Sequence
  CVS mutant V244
atgtcatctggtgaaacttttagaccaactgctgattttcatccatctttgtggaaaaatcattttttgcaaggtgcatcagattttaagactgttgatcatacagctacaaatgaaagacatgaagctttgaaggaagaagttagaagaatgattttagcaaccggaaggaaaccaattcaaaaattgagattgattgatgaagttcaaagattgggtgttgcttaccattttgaaaaagaaattgaagatatgttggatcacatttacagagctgatccttattttgaggctcatgaatacaatgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatctgcagctccacatttgaagtcacctttggctgaacaaattaaccatgctttgtatagaccattgagaaaaactttgccaagattggaagcaagatacattatgtcatcaatctatgacaaggaacaatcgaagaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttggggacttattttgaatcacaatacgcttttggtagaaaaatcatgactaaattgaactacattttgtccattattgatgatacctacgatgcttacggtactttggaagaatgcacgatgttcagtgaagctgttgctcgttggaacactgaagctgttgatatgttgccagattatatgcgaattatctacagaactttgttggatacattcaacgaaatagaagaggatatggctaaacaacggagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggaatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagatgttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 779 - DNA, 1644 bp, Artificial Sequence
  CVS mutant V245
atgtcatctggtgaaacttttagaccaactgctgattttcatccatctttgtggaaaaatcattttttgcaaggtgcatcagattttaagactgttgatcatacagctacaaatgaaagacatgaagctttgaaggaagaagttagaagaatgattttagcaaccggaaggaaaccaattcaaaaattgagattgattgatgaagttcaaagattgggtgttgcttaccattttgaaaaagaaattgaagatatgttggatcacatttacagagctgatccttattttgaggctcatgaatacaatgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatctgcagctccacatttgaagtcacctttggctgaacaaattaaccatgctttgtatagaccattgagaaaaactttgccaagattggaagcaagatacattatgtcagtctaccaagatgaagctttccataacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttggggacttattttgaatcacaatacgcttttggtagaaaaatcatgactaaattgaactacattttgtccattattgatgatacctacgatgcttacggtactttggaagaatgcacgatgttcagtgaagctgttgctcgttggaacattgaagctgttgatatgttgccagattatatgcgaattatctacagaactttgttggatacattcaacgaaatagaagaggatatggctaaacaacggagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagatgttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 780 - DNA, 1650 bp, Artificial Sequence
  CVS mutant V246
atgtcatctggtgaaacttttagaccaactgctgattttcatccatctttgtggaaaaatcattttttgcaaggtgcatcagattttaagactgttgatcatacagctacaaatgaaagacatgaagctttgaaggaagaagttagaagaatgattttagcaaccggaaggaaaccaattcaaaaattgagattgattgatgaagttcaaagattgggtgttgcttaccattttgaaaaagaaattgaagatatgttggatcacatttacagagctgatccttattttgaggctcatgaatacaatgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatctgcagctccacatttgaagtcacctttggctgaacaaattaaccatgctttgtataggccattgagaaaaactttgccaagattggaagcaagatacattatgtcatattcacctaacgttatcgacctagctccaaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttgggtacttattttgaaccacaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 781 - DNA, 1650 bp, Artificial Sequence
  CVS mutant V247
atgtcatctggtgaaacttttagaccaactgctgattttcatccatctttgtggaaaaatcattttttgcaaggtgcatcagattttaagactgttgatcatacagctacaaatgaaagacatgaagctttgaaggaagaagttagaagaatgattttagcaaccggaaggaaaccaattcaaaaattgagattgattgatgaagttcaaagattgggtgttgcttaccattttgaaaaagaaattgaagatatgttggatcacatttacagagctgatccttattttgaggctcatgaatacaatgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatctgcagctccacatttgaagtcacctttggctgaacaaattaaccatgctttgtatagaccattgagaaaaactttgccaagattggaagcaagatacattatgtcaaagcctgtgacgcgcagcctatcggcactgaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttgggtacttattttgaaccacaatacgcttttggtagaaaaatcatgactaaattgaactacattttgtccattattgatgatacctacgatgcttacggtactttggaagaattgtctttgttcaccgaagctgctgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 782 - DNA, 1650 bp, Artificial Sequence
  CVS mutant V248
atgtcatctggtgaaacttttagaccaactgctgattttcatccatctttgtggaaaaatcattttttgcaaggtgcatcagattttaagactgttgatcatacagctacaaatgaaagacatgaagctttgaaggaagaagttagaagaatgattttagcaaccggaaggaaaccaattcaaaaattgagattgattgatgaagttcaaagattgggtgttgcttaccattttgaaaaagaaattgaagatatgttggatcacatttacagagctgatccttattttgaggctcatgaatacaatgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatctgcagctccacatttgaagtcacctttggctgaacaaattaaccatgctttgtatagaccattgagaaaaactttgccaagattggaagcaagatacattatgtcaatgcagcacttatgtttctcccgtcataaaaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttgggtacttattttgaaccacaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaagccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 783 - DNA, 1650 bp, Artificial Sequence
  CVS mutant V249
atgtcatctggtgaaacttttagaccaactgctgattttcatccatctttgtggaaaaatcattttttgcaaggtgcatcagattttaagactgttgatcatacagctacaaatgaaagacatgaggctttgaaggaagaagttagaagaatgattttagcaaccggaaggaaaccaattcaaaaattgagattgattgatgaagttcaaagattgggtgttgcttaccattttgaaaaagaaattgaagatatgttggatcacatttacagagctgatccttattttgaggctcatgaatacaatgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatctgcagctccacatttgaagtcacctttggctgaacaaattaaccatgctttgtatagaccattgagaaaaactttgccaagattggaagcaagatacattatgtcatttaattgtgtaaaatacgccttcacccagaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttgggtacttattttgaaccacaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 784 - DNA, 1650 bp, Artificial Sequence
  CVS mutant V250
atgtcatctggtgaaacttttagaccaactgctgattttcatccatctttgtggaaaaatcattttttgcaaggtgcatcagattttaagactgttgatcatacagctacaaatgaaagacatgaagctttgaaggaagaagttagaagaatgattttagcaaccggaaggaaaccaattcaaaaattgagattgattgatgaagttcaaagattgggtgttgcttaccattttgaaaaagaaattgaagatatgttggatcacatttacagagctgatccttattttgaggctcatgaatacaatgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatctgcagctccacatttgaagtcacctttggctgaacaaattaaccatgctttgtatagaccattgagaaaaactttgccaagattggaagcaagatacattatgtcataccgtctaaatgataattacgcagaatggaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttgggtacttattttgaaccacaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 785 - DNA, 1650 bp, Artificial Sequence
  CVS mutant V251
atgtcatctggtgaaacttttagaccaactgctgattttcatccatctttgtggagaaatcattttttgcaaggtgcatcaggttttaagactgttgatcatacagctacaaatgaaagacatgaagctttgaaggaagaagttagaagaatgattttagcaaccggaaggaaaccaattcaaagattgagattgattgatgaagttcaaagattgggtgttgcttaccattttgaaaaagaaattgaagatatgttggatcacatttacagagctgatccttattttgaggctcatgaatacaatgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatctgcagctccacatttgaagtcacctttggctgaacaaattaaccatgctttgtatagaccattgagaaaaactttgccaagattggaagcaagatacattatgtcatccaaggcacaagcacatagcctcgtgagtaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttgggtacttattttgaaccacaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 786 - DNA, 1650 bp, Artificial Sequence
  CVS mutant V252
atgtcatctggtgaaacttttagaccaactgctgattttcatccatctttgtggagaaatcattttttgcaaggtgcatcagattttaagactgttgatcatacagctacaaatgaaagacatgaagctttgaaggaagaagttagaagaatgattttagcaaccggaaggaaaccaattcaaagattgagattgattgatgaagttcaaagattgggtgttgcttaccattttgaaaaagaaattgaagatatgttggatcacatttacagagctgatccttattttgaggctcatgaatacaatgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatctgcagctccacatttgaagtcacctttggctgaacaaattaaccatgctttgtatagaccattgagaaaaactttgccaagattggaagcaagatacattatgtcaagtttggtgcggtctgagaaagatccaaataacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttgggtacttattttgaaccacaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 787 - DNA, 1650 bp, Artificial Sequence
  CVS mutant V253
atgtcatctggtgaaacttttagaccaactgctgattttcatccatctttgtggaaaaatcattttttgcaaggtgcatcagattttaagactgttgatcatacagctacaaatgaaagacatgaagctttgaaggaagaagttagaagaatgattttagcaaccggaaggaaaccaattcaaaaattgagattgattgatgaagttcaaagattgggtgttgcttaccattttgaaaaagaaattgaagatatgttggatcacatttacagagctgatccttattttgaggctcatgaatacaatgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatctgcagctccacatttgaagtcacctttggctgaacaaattaaccatgctttgtatagaccattgagaaaaactttgccaagattggaagcaagatacattatgtcacatcgcactccagctttctgcagaggcgaaaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttgggtacttattttgaaccacaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 788 - DNA, 1650 bp, Artificial Sequence
  CVS mutant V254
atgtcatctggtgaaacttttagaccaactgctgattttcatccatctttgtggaaaaatcattttttgcaaggtgcatcagattttaagactgttgatcatacagctacaaatgaaagacatgaagctttgaaggaagaagttagaagaatgattttagcaaccggaaggaaaccaattcaaaaattgagattgattgatgaagttcaaagattgggtgttgcttaccattttgaaaaagaaattgaagatatgttggatcacatttacagagctgatccttattttgaggctcatgaatacaatgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatctgcagctccacatttgaagtcacctttggctgaacaaattaaccatgctttgtatagaccattgagaaaaactttgccaagattggaagcaagatacattatgtcacaggtgaggaagcggtgtgtagaagcagtgaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttgggtacttattttgaaccacaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 789 - DNA, 1644 bp, Artificial Sequence
  CVS mutant V255
atgtcatctggtgaaacttttagaccaactgctgattttcatccatctttgtggaaaaatcattttttgcaaggtgcatcagattttaagactgttgatcatacagctacaaatgaaagacatgaagctttgaaggaagaagttagaagaatgattttagcaaccggaaggaaaccaattcaaaaattgagattgattgatgaagttcaaagattgggtgttgcttaccattttgaaaaagaaattgaagatatgttggatcacatttacagagctgatccttattttgaggctcatgaatacaatgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatctgcagctccacatttgaagtcacctttggctgaacaaattaaccatgctttgtatagaccattgagaaaaactttgccaagattggaagcaagatacattatgtcagtctaccaagatgaagctttccataacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttggggacttattttgaatcacaatacgcttttggtagaaaaatcatgactaaattgaactacattttgtccattattgatgatacctacgatgcttacggtactttggaagaatgcacgatgttcagtgaagctgttgctcgttggaacattgaagctgttgatatgttgccagattatatgcgaattatctacagaactttgttggatacattcaacgaaatagaagaggatatggctaaacaacggagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgctaggacacgaatttgaacaaaaaagaggtcacgttgcatctgcaattgaatgctatactaaacaacatggtgtttccaaggaagaggctatcaagatgttcgaggaagatgttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 790 - DNA, 1647 bp, Artificial Sequence
  CVS mutant V256
atgcaaacgtttaactgtgctagaccaactgctgattttcatccatctttgtggaaaaatcattttttgcaaggtgcatcagattttaagactgttgatcatacagctacaaatgaaagacatgaagctttgaaggaagaagttagaagaatgattttagcaaccggaaggaaaccaattcaaaaattgagattgattgatgaagttcaaagattgggtgttgcttaccattttgaaaaagaaattgaagatatgttggatcacatttacagagctgatccttattttgaggctcatgaatacaatgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatctgcagctccacatttgaagtcacctttggctgaacaaattaaccatgctttgtatagaccattgagaaaaactttgccaagattggaagcaagatacattatgtcatcaatctatgacaaggaacaatcgaagaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttggggacttattttgaatcacaatacgcttttggtagaaaaatcatgactaaattgaactacattttgtccattattgatgatacctacgatgcttacggtactttggaagaatgcacgatgttcagtgaagctgttgctcgttggaacattgaagctgttgatatgttgccagattatatgcgaattatctacagaactttgttggatacattcaacgaaatagaagaggatatggctaaacaacggagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagatgttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 791 - DNA, 1647 bp, Artificial Sequence
  CVS mutant V257
atggcaggccggggggcgtccagaccaactgctgattttcatccatctttgtggaaaaatcattttttgcaaggtgcatcagattttaagactgttgatcatacagctacaaatgaaagacatgaagctttgaaggaagaagttagaagaatgattttagcaaccggaaggaaaccaattcaaaaattgagattgattgatgaagttcaaagattgggtgttgcttaccattttgaaaaagaaattgaagatatgttggatcacatttacagagctgatccttattttgaggctcatgaatacaatgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatctgcagctccacatttgaagtcacctttggctgaacaaattaaccatgctttgtatagaccattgagaaaaactttgccaagattggaagcaagatacattatgtcatcaatctatgacaaggaacaatcgaagaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttggggacttattttgaatcacaatacgcttttggtagaaaaatcatgactaaattgaactacattttgtccattattgatgatacctacgatgcttacggtactttggaagaatgcacgatgttcagtgaagctgttgctcgttggaacattgaagctgttgatatgttgccagattatatgcgaattatctacagaactttgttggatacattcaacgaaatagaagaggatatggctaaacaacggagatctcattgtgtaagatacgctaaagaagagattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagatgttgctaacgcttggaaggatatcaatgaagaattaatgatgaaaccaccagttgttgctagaccattgttaggtactattttgaatttggctagagccatcgattttatctataaagaagatgacggttacactcattcttatttgattaaggaacaaatagcatctgttttgggtgatcatgttccattttaa

SEQ ID NO: 792 - DNA, 1647 bp, Artificial Sequence
  CVS mutant V258
atggttctcaaatccaagcgcagaccaactgctgattttcatccatctttgtggaaaaatcattttttgcaaggtgcatcagattttaagactgttgatcatacagctacaaatgaaagacatgaagctttgaaggaagaagttagaagaatgattttggcaaccggaaggaaaccaattcaaaaattgagattgattgatgaagttcaaagattgggtgttgcttaccattttgaaaaagaaattgaagatatgttggatcacatttacagagctgatccttattttgaggctcatgaatacaatgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatctgcagctccacatttgaagtcacctttggctgaacaaattaaccatgctttgtatagaccattgagaaaaactttgccaagattggaagcaagatacattatgtcatcaatctatgacaaggaacaatcgaagaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttggggacttattttgaatcacaatacgcttttggtagaaaaatcatgactaaattgaactacattttgtccattattgatgatacctacgatgcttacggtactttggaagaatgcacgatgttcagtgaagctgttgctcgttggaacattgaagctgttgatatgttgccagattatatgcgaattatctacagaactttgttggatacattcaacgaaatagaagaggatatggctaaacaacggagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagatgttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 793 - DNA, 1647 bp, Artificial Sequence
  CVS mutants V259 and V260
atgaaagaatgtacgatgttaagaccaactgctgattttcatccatctttgtggaaaaatcattttttgcaaggtgcatcagattttaagactgttgatcatacagctacaaatgaaagacatgaagctttgaaggaagaagttagaagaatgattttagcaaccggaaggaaaccaattcaaaaattgagattgattgatgaagttcaaagattgggtgttgcttaccattttgaaaaagaaattgaagatatgttggatcacatttacagagctgatccttattttgaggctcatgaatacaatgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatctgcagctccacatttgaagtcacctttggctgaacaaattaaccatgctttgtatagaccattgagaaaaactttgccaagattggaagcaagatacattatgtcatcaatctatgacaaggaacaatcgaagaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttggggacttattttgaatcacaatacgcttttggtagaaaaatcatgactaaattgaactacattttgtccattattgatgatacctacgatgcttacggtactttggaagaatgcacgatgttcagtgaagctgttgctcgttggaacattgaagctgttgatatgttgccagattatatgcgaattatctacagaactttgttggatacattcaacgaaatagaagaggatatggctaaacaacggagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaagcaacatggtgtttccaaggaagaggctatcaagatgttcgaggaagatgttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 794 - DNA, 1647 bp, Artificial Sequence
  CVS mutants V261 and V262
atgccatctggtgaaacttttagaccaactgctgattttcatccatctttgtggaaaaatcattttttgcaaggtgcatcagattttaagactgttgatcatacagctacaaatgaaagacatgaagctttgaaggaagaagttagaagaatgattttagcaaccggaaggaaaccaattcaaaaattgagattgattgatgaagttcaaagattgggtgttgcttaccattttgaaaaagaaattgaagatatgttggatcacatttacagagctgatccttattttgaggctcatgaatacaatgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatctgcagctccacatttgaagtcacctttggctgaacaaattaaccatgctttgtatagaccattgagaaaaactttgccaagattggaagcaagatacattatgtcatcaatctatgacaaggaacaatcgaagaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttggggacttattttgaatcacaatacgcttttggtagaaaaatcatgactaaattgaactacattttgtccattattgatgatacctacgatgcttacggtactttggaagaatgcacgatgttcagtgaagctgttgctcgttggaacattgaagctgttgatatgttgccagattatatgcgaattatctacagaactttgttggatacattcaacgaaatagaagaggatatggctaaacaacggagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagatgttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 795 - DNA, 1647 bp, Artificial Sequence
  CVS mutant V263
atgtgcatgacaggtgaatcgagaccaactgctgattttcatccatctttgtggaaaaatcattttttgcaaggtgcatcagattttaagactgttgatcatacagctacaaatgaaagacatgaagctttgaaggaagaagttagaagaatgattttagcaaccggaaggaaaccaattcaaaaattgagattgattgatgaagttcaaagattgggtgttgcttaccattttgaaaaagaaattgaagatatgttggatcacatttacagagctgatccttattttgaggctcatgaatacaatgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatctgcagctccacatttgaagtcacctttggctgaacaaattaaccatgctttgtatagaccattgagaaaaactttgccaagattggaagcaagatacattatgtcatcaatctatgacaaggaacaatcgaagaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttggggacttattttgaatcacaatacgcttttggtagaaaaatcatgactaaattgaactacattttgtccattattgatgatacctacgatgcttacggtactttggaagaatgcacgatgttcagtgaagctgttgctcgttggaacattgaagctgttgatatgttgccagattatatgcgaattatctacagaactttgttggatacattcaacgaaatagaagaggatatggctaaacaacggagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagatgttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 796 - DNA, 1647 bp, Artificial Sequence
  CVS mutant V264
atgcagaatcttggctactcgagaccaactgctgattttcatccatctttgtggaaaaatcattttttgcaaggtgcatcagattttaagactgttgatcatacagctacaaatgaaagacatgaagctttgaaggaagaagttagaagaatgattttagcaaccggaaggaaaccaattcaaaaattgagattgattgatgaagttcaaagattgggtgttgcttaccattttgaaaaagaaattgaagatatgttggatcacatttacagagctgatccttattttgaggctcatgaatacaatgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatctgcagctccacatttgaagtcacctttggctgaacaaattaaccatgctttgtatagaccattgagaaaaactttgccaagattggaagcaagatacattatgtcatcaatctatgacaaggaacaatcgaagaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttggggacttattttgaatcacaatacgcttttggtagaaaaatcatgactaaattgaactacattttgtccattattgatgatacctacgatgcttacggtactttggaagaatgcacgatgttcagtgaagctgttgctcgttggaacattgaagctgttgatatgttgccagattatatgcgaattatctacagaactttgttggatacattcaacgaaatagaagaggatatggctaaacaacggagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagatgttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 797 - DNA, 1647 bp, Artificial Sequence
  CVS mutant V265
atgttaaactcaatcgattcgagaccaactgctgattttcatccatctttgtggaaaaatcattttttgcaaggtgcatcagattttaagactgttgatcatacagctacaaatgaaagacatgaagctttgaaggaagaagttagaagaatgattttagcaaccggaaggaaaccaattcaaaaattgagattgattgatgaagttcaaagattgggtgttgcttaccattttgaaaaagaaattgaagatatgttggatcacatttacagagctgatccttattttgaggctcatgaatacaatgatttgcatactgtttctttgcatttcagattgttgagacaacaaggtattaagatttcctgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatctgcagctccacatttgaagtcacctttggctgaacaaattaaccatgctttgtatagaccattgagaaaaactttgccaagattggaagcaagatacattatgtcatcaatctatgacaaggaacaatcgaagaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttggggacttattttgaatcacaatacgcttttggtagaaaaatcatgactaaattgaactacattttgtccattattgatgatacctacgatgcttacggtactttggaagaatgcacgatgttcagtgaagctgttgctcgttggaacattgaagctgttgatatgttgccagattatatgcgaattatctacagaactttgttggatacattcaacgaaatagaagaggatatggctaaacaacggagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagatgttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 798 - DNA, 1647 bp, Artificial Sequence
  CVS mutant V266
atgcctgaccgcaccggaccaagaccaactgctgattttcatccatctttgtggaaaaatcattttttgcaaggtgcatcagattttaagactgttgatcatacagctacaaatgaaagacatgaagctttgaaggaagaagttagaagaatgattttagcaaccggaaggaaaccaattcaaaaattgagattgattgatgaagttcaaagattgggtgttgcttaccattttgaaaaagaaattgaagatatgttggatcacatttacagagctgatccttattttgaggctcatgaatacaatgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatctgcagctccacatttgaagtcacctttggctgaacaaattaaccatgctttgtatagaccattgagaaaaactttgccaagattggaagcaagatacattatgtcatcaatctatgacaaggaacaatcgaagaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttggggacttattttgaatcacaatacgcttttggtagaaaaatcatgactaaattgaactacattttgtccattattgatgatacctacgatgcttacggtactttggaagaatgcacgatgttcagtgaagctgttgctcgttggaacattgaagctgttgatatgttgccagattatatgcgaattatctacagaactttgttggatacattcaacgaaatagaagaggatatggctaaacaacggagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagatgttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 799 - DNA, 1650 bp, Artificial Sequence
  CVS mutant V267
atgtcatctggtgaaacttttagaccaactgctgattttcatccatctttgtggaaaaatcattttttgcaaggtgcatcagattttaagactgttgatcatacagctacaaatgaaagacatgaagctttgaaggaagaagttagaagaatgattttagcaaccggaaggaaaccaattcaaaaattgagattgattgatgaagttcaaagattgggtgttgcttaccattttgaaaaagaaattgaagatatgttggatcacatttacagagctgatccttattttgaggctcatgaatacaatgatttgcatactgtttctcttcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatctgcagctccacatttgaagtcacctttggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttggggacttattttgaatcacaatacgcttttggtagaaaaatcatgactaaattgaactacattttgtccattattgatgatacctacgatgcttacggtactttggaagaatgcacgatgttcagtgaagctgttgctcgttggaacattgaagctgttgatatgttgccagattatatgcgaattatctacagaactttgttggatacattcaacgaaatagaagaggatatggctaaacaacggagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagatgttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 800 - DNA, 1647 bp, Artificial Sequence
  CVS mutant V227
atgtcatctggtgaaacttttagaccaactgctgattttcatccatctttgtggagaaatcattttttgcaaggtgcatcagattttaagactgttgatcatacagctacaaatgaaagacatgaagctttgaaggaagaagttagaagaatgattactgatgcagaagatcaaccaattcaaaaattgagattgattgatgaagttcaaagattgggtgttgcttaccattttgaaaaagaaattgaagatgctattcaacaattgtgtccaattcatattgattctgataaagctgatttgcatactgtttctttgcatttcagattgttgagacaacaaggtattaagatttcttgtgatgttttcgaacaatttaaggatgatgaaggtagattcaaaagttctttgattaatgatgttcagggcatgttgtctttgtatgaagctgcttatatggctgttagaggtgaacatattttggatgaagctattgcatttactactactcatttgcaatcattggttgcacaagatcatgttactccaagattggctgaacaaattaaccatgctttgtatagaccattgagaaaaactttgccaagattggaagcaagataccacatgtcaagaattgattctacttctgatgatttggttaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttggggacttattttgaatcacaatacgcttttggtagaaaaatcatgactaaattgaactacattttgtccattattgatgatacctacgatgcttacggtactttggaagaatgcacgatgttcagtgaagctgttgctcgttggaacattgaagctgttgatatgttgccagattatatgcgaattatctacagaactttgttggatacattcaacgaaatagaagaggatatggctaaacaacggagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 801 - DNA, 1587 bp, Artificial Sequence
  CVS mutant V268 (AA22-548)
tttttgcaaggtgcatcagattttaagactgttgatcatacagctacaaatgaaagacatgaagctttgaaggaagaagttagaagaatgattttagcaaccggaaggaaaccaattcaaaaattgagattgattgatgaagttcaaagattgggtgttgcttaccattttgaaaaagaaattgaagatatgttggatcacatttacagagctgatccttattttgaggctcatgaatacaatgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatctgcagctccacatttgaagtcacctttggctgaacaaattaaccatgctttgtatagaccattgagaaaaactttgccaagattggaagcaagatacgagatgtcaagaattgattctacttctgatgatttggttaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttggggacttattttgaatcacaatacgcttttggtagaaaaatcatgactaaattgaactacattttgtccattattgatgatacctacgatgcttacggtactttggaagaatgcacgatgttcagtgaagctgttgctcgttggaacattgaagctgttgatatgttgccagattatatgcgaattatctacagaactttgttggatacattcaacgaaatagaagaggatatggctaaacaacggagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagatgttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 802 - DNA, 1650 bp, Artificial Sequence
  CVS mutant V269
atgtcatctggtgaaacttttagaccaactgctgattttcatccatctttgtggagaaatcattttttgcaaggtgcatcagattttaagactgttgatcatacagctacaaatgaaagacatgaagctttgaaggaagaagttagaagaatgattttagcaaccggaaggaaaccaattcaaaaattgagattgattgatgaagttcaaagattaggtgttgcttaccattttgaaaaagaaattgaagatatgttggatcacatttacagagctgatccttattttgaggctcatgaatacaatgatttgcatactgtttctttgcatttcagattgtcgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatctgcagctccacatttgaagtcacctttggctgaacaaattaaccatgctttgtatagaccattgagaaaaactttgccaagattggaagcaagatacgaaatgtcaagaattgattctacttctgatgatttggttaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttggggacttattttgaatcacaatacgcttttggtagaaaaatcatgactaaattgaactacattttgtccattattgatgatacctacgatgcttacggtactttggaagaatgcacgatgttcagtgaagctgttgctcgttggaacattgaagctgttgatatgttgccagattatatgcgaattatctacagaactttgttggatacattcaacgaaatagaagaggatatggctaaacaacggagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagatgttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 803 - DNA, 1650 bp, Artificial Sequence
  CVS mutant V270
atgtcatctggtgaaacttttagaccaactgctgattttcatccatctttgtggaaaaatcattttttgcaaggtgcatcagattttaagactgttgatcatacagctacaaatgaaagacatgaagctttgaaggaagaagttagaagaatgattttagcaaccggaaggaaaccaattcaaaaattgagattgattgatgaagttcaaagattgggtgttgcttaccattttgaaaaagaaattgaagatatgttggatcacatttacagagctgatccttattttgaggctcatgaatacaatgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatctgcagctccacatttgaagtcacctttggctgaacaaattaaccatgctttgtatagaccattgagaaaaactttgccaagattggaagcaagatacttaatgtcaagaattgattctacttctgatgatttggttaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttggggacttattttgaatcacaatacgcttttggtagaaaaatcatgactaaattgaactacattttgtccattattgatgatacctacgatgcttacggtactttggaagaatgcacgatgttcagtgaagctgttgctcgttggaacattgaagctgttgatatgttgccagattatatgcgaattatctacagaactttgttggatacattcaacgaaatagaagaggatatggctaaacaacggagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagatgttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 804 - DNA, 1650 bp, Artificial Sequence
  CVS mutant V271
atgtcatctggtgaaacttttagaccaactgctgattttcatccatctttgtggaaaaatcattttttgcaaggtgcatcagattttaagactgttgatcatacagctacaaatgaaagacatgaagctttgaaggaagaagttagaagaatgattttagcaaccggaaggaaaccaattcaaaaattgagattgattgatgaagttcaaagattgggtgttgcttaccattttgaaaaagaaattgaagatatgttggatcacatttacagagctgatccttattttgaggctcatgaatacaatgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatctgcagctccacatttgaagtcacctttggctgaacaaattaaccatgctttgtatagaccattgagaaaaactttgccaagattggaagcaagatacacgatgtcaagaattgattctacttctgatgatttggttaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttggggacttattttgaatcacaatacgcttttggtagaaaaatcatgactaaattgaactacattttgtccattattgatgatacctacgatgcttacggtactttggaagaatgcacgatgttcagtgaagctgttgctcgttggaacattgaagctgttgatatgttgccagattatatgcgaattatctacagaactttgttggatacattcaacgaaatagaagaggatatggctaaacaacggagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagatgttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 805 - DNA, 1650 bp, Artificial Sequence
  CVS mutant V272
atgtcatctggtgaaacttttagaccaactgctgattttcatccatctttgtggaaaaatcattttttgcaaggtgcatcagattttaagactgttgatcatacagctacaaatgaaagacatgaagctttgaaggaagaagttagaagaatgattttagcaaccggaaggaaaccaattcaaaaattgagattgattgatgaagttcaaagattgggtgttgcttaccattttgaaaaagaaattgaagatatgttggatcacatttacagagctgatccttattttgaggctcatgaatacaatgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatctgcagctccacatttgaagtcacctttggctgaacaaattaaccatgctttgtatagaccattgagaaaaactttgccaagattggaagcaagatacattatgtcagcctttctggcttgcggccgtcgacccacaaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttgggtacttattttgaaccacaatacgcttttggtagaaaaatcatgactaaattgaactacattttgtccattattgatgatacctacgatgcttacggtactttggaagaatgcacgatgttcagtgaagctgttgctcgttggaacattgaagctgttgacatgttgccagattatatgcgaattatctacagaactttgttggatacattcaacgaaatagaagaggatatggctaaacaacggagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 806 - DNA, 1647 bp, Artificial Sequence
  CVS mutant V273
atggcaacttctcacagtcagagaccaactgctgattttcatccatctttgtggaaaaatcattttttgcaaggtgcatcagattttaagactgttgatcatacagctacaaatgaaagacatgaagctttgaaggaagaagttagaagaatgattttagcaaccggaaggaaaccaattcaaaaattgagattgattgatgaagttcaaagattgggtgttgcttaccattttgaaaaagaaattgaagatatgttggatcacatttacagagctgatccttattttgaggctcatgaatacaatgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatctgcagctccacatttgaagtcacctttggctgaacaaattaaccatgctttgtatagaccattgagaaaaactttgccaagattggaagcaagatacattatgtcatcaatctatgacaaggaacaatcgaagaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttggggacttattttgaatcacaatacgcttttggtagaaaaatcatgactaaattgaactacattttgtccattattgatgatacctacgatgcttacggtactttggaagaatgcacgatgttcagtgaagctgttgctcgttggaacactgaagctgttgatatgttgccagattatatgcgaattatctacagaactttgttggatacattcaacgaaatagaagaggatatggctaaacaacggagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggaatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagatgttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 807 - DNA, 1680 bp, Artificial Sequence
  CVS mutant V274
atgtctactcaagtctcagcatcttctctagcccagattccccaacccaaaaatcgtcctgtggcaaactttcaccccaacatttggggtgaccaatttatcacctacactcctgaagacaaggttactcgtgcctgcaaagaggagcagattgaagctttgaaggaagaagttagaagaatgattttagcaaccggaaggaaaccaattcaaaaattgagattgattgatgaagttcaaagattgggtgttgcttaccattttgaaaaagaaattgaagatatgttggatcacatttacagagctgatccttattttgaggctcatgaatacaatgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatctgcagctccacatttgaagtcacctttggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttggggacttattttgaatcacaatacgcttttggtagaaaaatcatgactaaattgaactacattttgtccattattgatgatacctacgatgcttacggtactttggaagaatgcacgatgttcagtgaagctgttgctcgttggaacattgaagctgttgatatgttgccagattatatgcgaattatctacagaactttgttggatacattcaacgaaatagaagaggatatggctaaacaacggagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagatgttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 808 - DNA, 1653 bp, Artificial Sequence
  CVS mutant V275
atgtcatctggtgaaacttttagaccaactgctgattttcatccatctttgtggagaaatcattttttgcaaggtgcatcagattttaagactgttgatcatacagctacaaatgaaagacatgaagctttgaaggaagaagttagaagaatgattactgatgcagaagatcaaccaattcaaaaattgagattgattgatgaagttcaaagattgggtgttgcttaccattttgaaaaagaaattgaagatgcattacaacatatttgtaataattttcatgactgcaatgatatggatggtgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttggggacttattttgaatcacaatacgcttttggtagaaaaatcatgactaaattgaactacattttgtccattattgatgatacctacgatgcttacggtactttggaagaatgcacgatgttcagtgaagctgttgctcgttggaacattgaagctgttgatatgttgccagattatatgcgaattatctacagaactttgttggatacattcaacgaaatagaagaggatatggctaaacaacggagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 809 - DNA, 1653 bp, Artificial Sequence
  CVS mutant V276
atgtcatctggtgaaacttttagaccaactgctgattttcatccatctttgtggagaaatcattttttgcaaggtgcatcagattttaagactgttgatcatacagctacaaatgaaagacatgaagctttgaaggaagaagttagaagaatgattactgatgcagaagatcaaccaattcaaaaattgagattgattgatgaagttcaaagattgggtgttgcttaccattttgaaaaagaaattgaagatgcattacaacatatttgtaatagttttcatgactgcaatgatatggatggtgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctctgtatgaagctgcttatatggctgttagaggtgaacatattttggatgaagctattgcatttactactactcatttgcaatcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttggggacttattttgaatcacaatacgcttttggtagaaaaatcatgactaaattgaactacattttgtccattattgatgatacctacgatgcttacggtactttggaagaatgcacgatgttcagtgaagctgttgctcgttggaacattgaagctgttgatatgttgccagattatatgcgaattatctacagaactttgttggatacattcaacgaaatagaagaggatatggctaaacaacggagatctcattgtgtaagatacgctaaagaagaaattcaaaaggttattggtgcttattacgttcaagctaagtggttttctgaaggttgtgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatctgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 810 - protein, 548 aa, Artificial Sequence
  CVS mutant V179
MSSGETFRPTADFHPSLWRNHFLQGASDFKTVDHTATNERHEALKEEVRRMITDAEDQPIQKLRLIDEVQRLGVAYHFEKEIEDAIQQLCPIHIDSDKADLHTVSLHFRLLRQQGIKISCDVFEQFKDDEGRFKSSLINDVQGMLSLYEAAYMAVRGEHILDEAIAFTTTHLQSLVAQDHVTPRLAEQINHALYRPLRKTLPRLEARYIMSRIDSTSDDLVNKTLLNFAKLDFNILLDLHKEELNELTKWWQDLDFTTKLPYARDRLVELYFWDLGTYFESSYAFGRKIMTKLNYILSIIDDTYDAYGTLPELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 811 - protein, 449 aa, Artificial Sequence
  CVS mutant V180 (AA100-548)
DLHTVSLHFRLLRQQGIKISCDVFEQFKDDEGRFKSSLINDVQGMLSLYEAAYMAVRGEHILDEAIAFTTTHLQSLVAQDHVTPRLAEQINHALYRPLRKTLPRLEARYIMSRIDSTSDDLVNKTLLNFAKLDFNILLDLHKEELNELTKWWQDLDFTTKLPYARDRLVELYFWDLGTYFESSYAFGRKIMTKLNYILSIIDDTYDAYGTHEELSLFTKAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 812 - protein, 494 aa, Artificial Sequence
  CVS mutant V181 (AA55-548)
AEDQPIQKLRLIDEVQRLGVAYHFEKEIEDAIQQLCPIHIDSDKADLHTVSLHFRLLRQQGIKISCDVFEQFKDDEGRFKSSLINDVQGMLSLYEAAYMAVRGEHILDEAIAFTTTHLQSLVAQDHVTPRLAEQINHALYRPLRKTLPRLEARYIMSRIDSTSDDLVNKTLLNFAKLDFNILLDLHKEELNELTKWWQDLDFTTKLPYARDRLVELYFWDLGTYFESSYAFGRKIMTKLNYILSIIDDTYDAYGTHEELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 813 - protein, 548 aa, Artificial Sequence
  CVS mutant V184
MSSGETFRPTADFHPSLWRNHFLQGASDFKTVDHTATNERHEALKEEVRRMITDAEDQPIQKLRLIDEVQRLGVAYHFEKEIEDAIQQLCPIHIDSDKADLHTVSLHFRLLRQQGIKISCDVFEQFKDDEGRFKSSLINDVQGMLSLYEAAYMAVRGEHILDEAIAFTTTHLQSLVAQDHVTPRLAEQINHALYRPLRKTLPRLEARYIMSRIDSTSDDLVNKTLLNFAKLDFNILLDLHKEELNELTKWWQDLDFTTKLPYARDRLVELYFWDLGTYFEPQYAFGRKIMTKLNYILSIIDDTYDAYGTLEELSLFTEAVARWNIEAVDMLPDYMKLIYRTLLDTFNEIEEDMAKQGRSLCVRYAKEEIHKVIGDYYVQAKWFSEGYVPTIEEYMPIALTSCAYRFVIGNSFLGMGDFATKEVFEWISGNPKVVKSASVICRLMDDMQGHEFEQKRGHVASAIECYTKQHGVSKEEAIKMFEEEVANAWKDINEGLMMKPPVVARPLLGTILNLARAIDFIYKEDDGYTHSYLIKEQIASVLGDHVPF

SEQ ID NO: 814 - protein, 548 aa, Artificial Sequence
  CVS mutant V186
MPRRDRARPTADFHPSLWRNHFLQGASDFKTVDHTATNERHEALKEEVRRMITDAEDQPIQKLRLIDEVQRLGVAYHFEKEIEDAIQQLCPIHIDSDKADLHTVSLHFRLLRQQGIKISCDVFEQFKDDEGRFKSSLINDVQGMLSLYEAAYMAVRGEHILDEAIAFTTTHLQSLVAQDHVTPRLAEQINHALYRPLRKTLPRLEARYIMSRIDSTSDDLVNKTLLNFAKLDFNILLDLHKEELNELTKWWQDLDFTTKLPYARDRLVELYFWDLGTYFEPQYAFGRKIMTKLNYILSIIDDTYDAYGTLEELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 815 - protein, 548 aa, Artificial Sequence
  CVS mutant V187
MSLSHDSRPTADFHPSLWRNHFLQGASDFKTVDHTATNERHEALKEEVRRMITDAEDQPIQKLRLIDEVQRLGVAYHFEKEIEDAIQQLCPIHIDSDKADLHTVSLHFRLLRQQGIKISCDVFEQFKDDEGRFKSSLINDVQGMLSLYEAAYMAVRGEHILDEAIAFTTTHLQSLVAQDHVTPRLAEQINHALYRPLRKTLPRLEARYIMSRIDSTSDDLVNKTLLNFAKLDFNILLDLHKEELNELTKWWQDLDFTTKLPYARDRLVELYFWDLGTYFEPQYAFGRKIMTKLNYILSIIDDTYDAYGTLEELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 816 - protein, 548 aa, Artificial Sequence
  CVS mutant V188
MTRGILKRPTADFHPSLWRNHFLQGASDFKTVDHTATNERHEALKEEVRRMITDAEDQPIQKLRLIDEVQRLGVAYHFEKEIEDAIQQLCPIHIDSDKADLHTVSLHFRLLRQQGIKISCDVFEQFKDDEGRFKSSLINDVQGMLSLYEAAYMAVRGEHILDEAIAFTTTHLQSLVAQDHVTPRLAEQINHALYRPLRKTLPRLEARYIMSRIDSTSDDLVNKTLLNFAKLDFNILLDLHKEELNELTKWWQDLDFTTKLPYARDRLVELYFWDLGTYFEPQYAFGRKIMTKLNYILSIIDDTYDAYGTLEELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 817 - protein, 548 aa, Artificial Sequence
  CVS mutant V189
MLDSIAGRPTADFHPSLWRNHFLQGASDFKTVDHTATNERHEALKEEVRRMITDAEDQPIQKLRLIDEVQRLGVAYHFEKEIEDAIQQLCPIHIDSDKADLHTVSLHFRLLRQQGIKISCDVFEQFKDDEGRFKSSLINDVQGMLSLYEAAYMAVRGEHILDEAIAFTTTHLQSLVAQDHVTPRLAEQINHALYRPLRKTLPRLEARYIMSRIDSTSDDLVNKTLLNFAKLDFNILLDLHKEELNELTKWWQDLDFTTKLPYARDRLVELYFWDLGTYFEPQYAFGRKIMTKLNYILSIIDDTYDAYGTLEELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 818 - protein, 548 aa, Artificial Sequence
  CVS mutant V190
MHEPSETRPTADFHPSLWRNHFLQGASDFKTVDHTATNERHEALKEEVRRMITDAEDQPIQKLRLIDEVQRLGVAYHFEKEIEDAIQQLCPIHIDSDKADLHTVSLHFRLLRQQGIKISCDVFEQFKDDEGRFKSSLINDVQGMLSLYEAAYMAVRGEHILDEAIAFTTTHLQSLVAQDHVTPRLAEQINHALYRPLRKTLPRLEARYIMSRIDSTSDDLVNKTLLNFAKLDFNILLDLHKEELNELTKWWQDLDFTTKLPYARDRLVELYFWDLGTYFEPQYAFGRKIMTKLNYILSIIDDTYDAYGTLEELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 819 - protein, 548 aa, Artificial Sequence
  CVS mutant V191
MLGVSEQRPTADFHPSLWRNHFLQGASDFKTVDHTATNERHEALKEEVRRMITDAEDQPIQKLRLIDEVQRLGVAYHFEKEIEDAIQQLCPIHIDSDKADLHTVSLHFRLLRQQGIKISCDVFEQFKDDEGRFKSSLINDVQGMLSLYEAAYMAVRGEHILDEAIAFTTTHLQSLVAQDHVTPRLAEQINHALYRPLRKTLPRLEARYIMSRIDSTSDDLVNKTLLNFAKLDFNILLDLHKEELNELTKWWQDLDFTTKLPYARDRLVELYFWDLGTYFEPQYAFGRKIMTKLNYILSIIDDTYDAYGTLEELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 820 - protein, 548 aa, Artificial Sequence
  CVS mutant V192
MRVAPKFRPTADFHPSLWRNHFLQGASDFKTVDHTATNERHEALKEEVRRMITDAEDQPIQKLRLIDEVQRLGVAYHFEKEIEDAIQQLCPIHIDSDKADLHTVSLHFRLLRQQGIKISCDVFEQFKDDEGRFKSSLINDVQGMLSLYEAAYMAVRGEHILDEAIAFTTTHLQSLVAQDHVTPRLAEQINHALYRPLRKTLPRLEARYIMSRIDSTSDDLVNKTLLNFAKLDFNILLDLHKEELNELTKWWQDLDFTTKLPYARDRLVELYFWDLGTYFEPQYAFGRKIMTKLNYILSIIDDTYDAYGTLEELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 821 - protein, 548 aa, Artificial Sequence
  CVS mutant V193
MRAELSLRPTADFHPSLWRNHFLQGASDFKTVDHTATNERHEALKEEVRRMITDAEDQPIQKLRLIDEVQRLGVAYHFEKEIEDAIQQLCPIHIDSDKADLHTVSLHFRLLRQQGIKISCDVFEQFKDDEGRFKSSLINDVQGMLSLYEAAYMAVRGEHILDEAIAFTTTHLQSLVAQDHVTPRLAEQINHALYRPLRKTLPRLEARYIMSRIDSTSDDLVNKTLLNFAKLDFNILLDLHKEELNELTKWWQDLDFTTKLPYARDRLVELYFWDLGTYFEPQYAFGRKIMTKLNYILSIIDDTYDAYGTLEELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 822 - protein, 548 aa, Artificial Sequence
  CVS mutant V195
MRVIDGGRPTADFHPSLWRNHFLQGASDFKTVDHTATNERHEALKEEVRRMITDAEDQPIQKLRLIDEVQRLGVAYHFEKEIEDAIQQLCPIHIDSDKADLHTVSLHFRLLRQQGIKISCDVFEQFKDDEGRFKSSLINDVQGMLSLYEAAYMAVRGEHILDEAIAFTTTHLQSLVAQDHVTPRLAEQINHALYRPLRKTLPRLEARYIMSRIDSTSDDLVNKTLLNFAKLDFNILLDLHKEELNELTKWWQDLDFTTKLPYARDRLVELYFWDLGTYFEPQYAFGRKIMTKLNYILSIIDDTYDAYGTLEELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 823 - protein, 548 aa, Artificial Sequence
  CVS mutant V199
MSSGETFRPTADFHPSLWRNHFLQGASDFKTVDHTATNERHEALKEEVRRMILAPPPRPIQKLRLIDEVQRLGVAYHFEKEIEDAIQQLCPIHIDSDKADLHTVSLHFRLLRQQGIKISCDVFEQFKDDEGRFKSSLINDVQGMLSLYEAAYMAVRGEHILDEAIAFTTTHLQSLVAQDHVTPRLAEQINHALYRPLRKTLPRLEARYIMSRIDSTSDDLVNKTLLNFAKLDFNILLDLHKEELNELTKWWQDLDFTTKLPYARDRLVELYFWDLGTYFEPQYAFGRKIMTKLNYILSIIDDTYDAYGTLEELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 824 - protein, 548 aa, Artificial Sequence; identical to SEQ ID NO: 729
  CVS mutant V201

SEQ ID NO: 825 - protein, 548 aa, Artificial Sequence
  CVS mutant V203
MSSGETFRPTADFHPSLWRNHFLQGASDFKTVDHTATNERHEALKEEVRRMITDAEDQPIQKLRLIDEVQRLGVAYHFEKEIEDAIQQLCPIHIDSDKADLHTVSLHFRLLRQQGIKISCDVFEQFKDDEGRFKSSLINDVQGMLSLYEAAYMAVRGEHILDEAIAFTTTHLQSLVAQDHVTPRLAERVNHALYRPLRKTLSRLEARYIMSRIDSTSDDLVNKTLLNFAKLDFNILLDLHKEELNELTKWWQDLDFTTKLPYARDRLVELYFWDLGTYFEPQYAFGRKIMTKLNYILSIIDDTYDAYGTLEELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 826 - protein, 548 aa, Artificial Sequence; identical to SEQ ID NO: 729
  CVS mutant V204

SEQ ID NO: 827 - protein, 548 aa, Artificial Sequence
  CVS mutant V205
MSSGETFRPTADFHPSLWRNHFLQGASDFKTVDHTATNERHEALKEEVRRMITDAEDQPIQKLRLIDEVQRLGVAYHFEKEIEDAIQQLCPIHIDSDKADLHTVSLHFRLLRQQGIKISCDVFEQFKDDEGRFKSSLINDVQGMLSLYEAAYMAVRGERILDEAIAFTTTHLQSLVAQDHVTPRLAEQINHALYRPLRKTLPRLEARYIMSRIDSTSDDLVNKTLLNFAKLDFNILLDLHKEELNELTKWWQDLDFTTKLPYARDRLVELYFWDLGTYFEPQYAFGRKIMTKLNYILSIIDDTYDAYGTLEELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 828 - protein, 548 aa, Artificial Sequence
  CVS mutant V206
MSSGETFRPTADFHPSLWRNHFLQGASDFKTVDHTATNERHEALKEEVRRMITDAEDQPIQKLRLIDEVQRLGVAYHFEKEIEDAIQQLCPIHIDSDKADLHTVSLHFRLLRQQGIKISCDVFEQFKDDEGRFKSSLINDVQGMLSLYEAAYMAVRGEKILDEAIAFTTTHLQSLVAQDHVTPRLAEQINHALYRPLRKTLPRLEARYIMSRIDSTSDDLVNKTLLNFAKLDFNILLDLHKEELNELTKWWQDLDFTTKLPYARDRLVELYFWDLGTYFEPQYAFGRKIMTKLNYILSIIDDTYDAYGTLEELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 829 - protein, 548 aa, Artificial Sequence
  CVS mutant V207
MSSGETFRPTADFHPSLWRNHFLQGASDFKTVDHTATNERHEALKEEVRRMITDAEDQPIQKLRLIDEVQRLGVAYHFEKEIEDAIQQLCPIHIDSDKADLHTVSLHFRLLRQQGIKISCDVFEQFKDDEGRFKSSLINDVQGMLSLYEAAYMAVRGEHILDEAIAFTTTHLQSLVAQDHVTPRLAEQPNHALYRPLRKTLPRLEARYIMSRIDSTSDDLVNKTLLNFAKLDFNILLDLHKEELNELTKWWQDLDFTTKLPYARDRLVELYFWDLGTYFEPQYAFGRKIMTKLNYILSIIDDTYDAYGTLEELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 830 - protein, 548 aa, Artificial Sequence
  CVS mutant V185
MSSGETFRPTADFHPSLWRNHFLQGASDFKTVDHTATNERHEALKEEVRRMITDAEDQPIQKLRLIDEVQRLGVAYHFEKEIEDAIQQLCPIHIDSDKADLHTVSLHFRLLRQQGIKISCDVFEQFKDDEGRFKSSLINDVQGMLSLYEAAYMAVRGEHILDEAIAFTTTHLQSLVAQDHVTPRLAEQINHALYRPLRKTLPRLEARYIMSRIDSTSDDLVNKTLLNFAKLDFNILLDLHKEELNELTKWWQDLDFTTKLPYARDRLVELYFWDLGTYFEPQYAFGRKIMTKLNYILSIIDDTYDAYGTLEELSLFTEAVARWNIEAVDMLPDYMKLIYRTLLDTFNEIEEDMAKQGRSHCVRYAKEEIHKVIGDYYVQAKWFSEGYVPTIEEYMPIALTSCAYRFVIGNSFLGMGDFATKEVFEWISGNPKVVKSASVICRLMDDMQGHEFEQKRGHVASAIECYTKQHGVSKEEAIKMFEEEVANAWKDINEGLMMKPPVVARPLLGTILNLARAIDFIYKEDDGYTHSYLIKEQIASVLGDHVPF

SEQ ID NO: 831 - protein, 548 aa, Artificial Sequence
  CVS mutant V222
MSSGETFRPTADFHPSLWRNHFLQGASDFKTVDHTATNERHEALKEEVRRMITDAEDQPIQKLRLIDEVQRLGVAYHFEKEIEDAIQQLCPIHIDSDKADLHTVSLHFRLLRQQGIKISCDVFEQFKDDEGRFKSSLINDVQGMLSLYEAAYMAVRGEHILDEAIAFTTTHLQSLVAQDHVTPRLAEQINHALYRPLRKTLPRLEARYIMSSLEPPFMHPCNKTLLNFAKLDFNILLDLHKEELNELTKWWQDLDFTTKLPYARDRLVELYFWDLGTYFEPQYAFGRKIMTKLNYILSIIDDTYDAYGTLEECTMFSEAVARWNIEAVDMLPDYMRIIYRTLLDTFNEIEEDMAKQRRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 832 - protein, 548 aa, Artificial Sequence
  CVS mutant V223
MSSGETFRPTADFHPSLWRNHFLQGASDFKTVDHTATNERHEALKEEVRRMITDAEDQPIQKLRLIDEVQRLGVAYHFEKEIEDAIQQLCPIHIDSDKADLHTVSLHFRLLRQQGIKISCDVFEQFKDDEGRFKSSLINDVQGMLSLYEAAYMAVRGEHILDEAIAFTTTHLQSLVAQDHVTPRLAEQINHALYRPLRKTLPRLEARYIMSAIYARTGRMNNKTLLNFAKLDFNILLDLHKEELNELTKWWQDLDFTTKLPYARDRLVELYFWDLGTYFEPQYAFGRKIMTKLNYILSIIDDTYDAYGTLEECTMFSEAVARWNIEAVDMLPDYMRIIYRTLLDTFNEIEEDMAKQRRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 833 - protein, 546 aa, Artificial Sequence
  CVS mutant V242
MSSGETFRPTADFHPSLWRNHFLQGASDFKTVDHTATNERHEALKEEVRRMITDAEDQPIQKLRLIDEVQRLGVAYHFEKEIEDAIQQLCPIHIDSDKADLHTVSLHFRLLRQQGIKISCDVFEQFKDDEGRFKSSLINDVQGMLSLYEAAYMAVRGEHILDEAIAFTTTHLQSLVAQDHVTPRLAEQINHALYRPLRKTLPRLEARYIMSIYEEEGFKNKTLLNFAKLDFNILLDLHKEELNELTKWWQDLDFTTKLPYARDRLVELYFWDLGTYFESQYAFGRKIMTKLNYILSIIDDTYDAYGTLEECTMFSEAVARWNIEAVDMLPDYMRIIYRTLLDTFNEIEEDMAKQRRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 834 - protein, 548 aa, Artificial Sequence
  CVS mutant V243
MSSGETFRPTADFHPSLWKNHFLQGASDFKTVDHTATNERHEALKEEVRRMILATGRKPIQKLRLIDEVQRLGVAYHFEKEIEDMLDHIYRADPYFEAHEYNDLHTVSLHFRLLRQQGIKISCDVFEQFKDDEGRFKSSLINDVQGMLSLYEAAYMAVRGEHILDEAIAFTTTHLQSAAPHLKSPLAEQINHALYRPLRKTLPRLEARYIMSSIYDKEQSKNKTLLNFAKLDFNILLDLHKEELNELTKWWQDLDFTTKLPYARDRLVELYFWDLGTYFESQYAFGRKIMTKLNYILSIIDDTYDAYGTLEECTMFSEAVARWNIEAVDMLPDYMRIIYRTLLDTFNEIEEDMAKQRRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEDVANAWKDINEELMMKPPVVARPLLGTILNLARAIDFIYKEDDGYTHSYLIKEQIASVLGDHVPF

SEQ ID NO: 835 - protein, 548 aa, Artificial Sequence
  CVS mutant V244
MSSGETFRPTADFHPSLWKNHFLQGASDFKTVDHTATNERHEALKEEVRRMILATGRKPIQKLRLIDEVQRLGVAYHFEKEIEDMLDHIYRADPYFEAHEYNDLHTVSLHFRLLRQQGIKISCDVFEQFKDDEGRFKSSLINDVQGMLSLYEAAYMAVRGEHILDEAIAFTTTHLQSAAPHLKSPLAEQINHALYRPLRKTLPRLEARYIMSSIYDKEQSKNKTLLNFAKLDFNILLDLHKEELNELTKWWQDLDFTTKLPYARDRLVELYFWDLGTYFESQYAFGRKIMTKLNYILSIIDDTYDAYGTLEECTMFSEAVARWNTEAVDMLPDYMRIIYRTLLDTFNEIEEDMAKQRRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEDVANAWKDINEELMMKPPVVARPLLGTILNLARAIDFIYKEDDGYTHSYLIKEQIASVLGDHVPF

SEQ ID NO: 836 - protein, 547 aa, Artificial Sequence
  CVS mutant V245
MSSGETFRPTADFHPSLWKNHFLQGASDFKTVDHTATNERHEALKEEVRRMILATGRKPIQKLRLIDEVQRLGVAYHFEKEIEDMLDHIYRADPYFEAHEYNDLHTVSLHFRLLRQQGIKISCDVFEQFKDDEGRFKSSLINDVQGMLSLYEAAYMAVRGEHILDEAIAFTTTHLQSAAPHLKSPLAEQINHALYRPLRKTLPRLEARYIMSVYQDEAFHNKTLLNFAKLDFNILLDLHKEELNELTKWWQDLDFTTKLPYARDRLVELYFWDLGTYFESQYAFGRKIMTKLNYILSIIDDTYDAYGTLEECTMFSEAVARWNIEAVDMLPDYMRIIYRTLLDTFNEIEEDMAKQRRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEDVANAWKDINEELMMKPPVVARPLLGTILNLARAIDFIYKEDDGYTHSYLIKEQIASVLGDHVPF

SEQ ID NO: 837 - protein, 549 aa, Artificial Sequence
  CVS mutant V246
MSSGETFRPTADFHPSLWKNHFLQGASDFKTVDHTATNERHEALKEEVRRMILATGRKPIQKLRLIDEVQRLGVAYHFEKEIEDMLDHIYRADPYFEAHEYNDLHTVSLHFRLLRQQGIKISCDVFEQFKDDEGRFKSSLINDVQGMLSLYEAAYMAVRGEHILDEAIAFTTTHLQSAAPHLKSPLAEQINHALYRPLRKTLPRLEARYIMSYSPNVIDLAPNKTLLNFAKLDFNILLDLHKEELNELTKWWQDLDFTTKLPYARDRLVELYFWDLGTYFEPQYAFGRKIMTKLNYILSIIDDTYDAYGTLEELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 838 - protein, 549 aa, Artificial Sequence
  CVS mutant V247
MSSGETFRPTADFHPSLWKNHFLQGASDFKTVDHTATNERHEALKEEVRRMILATGRKPIQKLRLIDEVQRLGVAYHFEKEIEDMLDHIYRADPYFEAHEYNDLHTVSLHFRLLRQQGIKISCDVFEQFKDDEGRFKSSLINDVQGMLSLYEAAYMAVRGEHILDEAIAFTTTHLQSAAPHLKSPLAEQINHALYRPLRKTLPRLEARYIMSKPVTRSLSALNKTLLNFAKLDFNILLDLHKEELNELTKWWQDLDFTTKLPYARDRLVELYFWDLGTYFEPQYAFGRKIMTKLNYILSIIDDTYDAYGTLEELSLFTEAAARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 839 - protein, 549 aa, Artificial Sequence
  CVS mutant V248
MSSGETFRPTADFHPSLWKNHFLQGASDFKTVDHTATNERHEALKEEVRRMILATGRKPIQKLRLIDEVQRLGVAYHFEKEIEDMLDHIYRADPYFEAHEYNDLHTVSLHFRLLRQQGIKISCDVFEQFKDDEGRFKSSLINDVQGMLSLYEAAYMAVRGEHILDEAIAFTTTHLQSAAPHLKSPLAEQINHALYRPLRKTLPRLEARYIMSMQHLCFSRHKNKTLLNFAKLDFNILLDLHKEELNELTKWWQDLDFTTKLPYARDRLVELYFWDLGTYFEPQYAFGRKIMTKLNYILSIIDDTYDAYGTLEELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 840 - protein, 549 aa, Artificial Sequence
  CVS mutant V249
MSSGETFRPTADFHPSLWKNHFLQGASDFKTVDHTATNERHEALKEEVRRMILATGRKPIQKLRLIDEVQRLGVAYHFEKEIEDMLDHIYRADPYFEAHEYNDLHTVSLHFRLLRQQGIKISCDVFEQFKDDEGRFKSSLINDVQGMLSLYEAAYMAVRGEHILDEAIAFTTTHLQSAAPHLKSPLAEQINHALYRPLRKTLPRLEARYIMSFNCVKYAFTQNKTLLNFAKLDFNILLDLHKEELNELTKWWQDLDFTTKLPYARDRLVELYFWDLGTYFEPQYAFGRKIMTKLNYILSIIDDTYDAYGTLEELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 841 - protein, 549 aa, Artificial Sequence
  CVS mutant V250
MSSGETFRPTADFHPSLWKNHFLQGASDFKTVDHTATNERHEALKEEVRRMILATGRKPIQKLRLIDEVQRLGVAYHFEKEIEDMLDHIYRADPYFEAHEYNDLHTVSLHFRLLRQQGIKISCDVFEQFKDDEGRFKSSLINDVQGMLSLYEAAYMAVRGEHILDEAIAFTTTHLQSAAPHLKSPLAEQINHALYRPLRKTLPRLEARYIMSYRLNDNYAEWNKTLLNFAKLDFNILLDLHKEELNELTKWWQDLDFTTKLPYARDRLVELYFWDLGTYFEPQYAFGRKIMTKLNYILSIIDDTYDAYGTLEELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 842 - protein, 549 aa, Artificial Sequence
  CVS mutant V251
MSSGETFRPTADFHPSLWRNHFLQGASGFKTVDHTATNERHEALKEEVRRMILATGRKPIQRLRLIDEVQRLGVAYHFEKEIEDMLDHIYRADPYFEAHEYNDLHTVSLHFRLLRQQGIKISCDVFEQFKDDEGRFKSSLINDVQGMLSLYEAAYMAVRGEHILDEAIAFTTTHLQSAAPHLKSPLAEQINHALYRPLRKTLPRLEARYIMSSKAQAHSLVSNKTLLNFAKLDFNILLDLHKEELNELTKWWQDLDFTTKLPYARDRLVELYFWDLGTYFEPQYAFGRKIMTKLNYILSIIDDTYDAYGTLEELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 843 - protein, 549 aa, Artificial Sequence
  CVS mutant V252
MSSGETFRPTADFHPSLWRNHFLQGASDFKTVDHTATNERHEALKEEVRRMILATGRKPIQRLRLIDEVQRLGVAYHFEKEIEDMLDHIYRADPYFEAHEYNDLHTVSLHFRLLRQQGIKISCDVFEQFKDDEGRFKSSLINDVQGMLSLYEAAYMAVRGEHILDEAIAFTTTHLQSAAPHLKSPLAEQINHALYRPLRKTLPRLEARYIMSSLVRSEKDPNNKTLLNFAKLDFNILLDLHKEELNELTKWWQDLDFTTKLPYARDRLVELYFWDLGTYFEPQYAFGRKIMTKLNYILSIIDDTYDAYGTLEELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 844 - protein, 549 aa, Artificial Sequence
  CVS mutant V253
MSSGETFRPTADFHPSLWKNHFLQGASDFKTVDHTATNERHEALKEEVRRMILATGRKPIQKLRLIDEVQRLGVAYHFEKEIEDMLDHIYRADPYFEAHEYNDLHTVSLHFRLLRQQGIKISCDVFEQFKDDEGRFKSSLINDVQGMLSLYEAAYMAVRGEHILDEAIAFTTTHLQSAAPHLKSPLAEQINHALYRPLRKTLPRLEARYIMSHRTPAFCRGENKTLLNFAKLDFNILLDLHKEELNELTKWWQDLDFTTKLPYARDRLVELYFWDLGTYFEPQYAFGRKIMTKLNYILSIIDDTYDAYGTLEELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 845 - protein, 549 aa, Artificial Sequence
  CVS mutant V254
MSSGETFRPTADFHPSLWKNHFLQGASDFKTVDHTATNERHEALKEEVRRMILATGRKPIQKLRLIDEVQRLGVAYHFEKEIEDMLDHIYRADPYFEAHEYNDLHTVSLHFRLLRQQGIKISCDVFEQFKDDEGRFKSSLINDVQGMLSLYEAAYMAVRGEHILDEAIAFTTTHLQSAAPHLKSPLAEQINHALYRPLRKTLPRLEARYIMSQVRKRCVEAVNKTLLNFAKLDFNILLDLHKEELNELTKWWQDLDFTTKLPYARDRLVELYFWDLGTYFEPQYAFGRKIMTKLNYILSIIDDTYDAYGTLEELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 846 - protein, 547 aa, Artificial Sequence
  CVS mutant V255
MSSGETFRPTADFHPSLWKNHFLQGASDFKTVDHTATNERHEALKEEVRRMILATGRKPIQKLRLIDEVQRLGVAYHFEKEIEDMLDHIYRADPYFEAHEYNDLHTVSLHFRLLRQQGIKISCDVFEQFKDDEGRFKSSLINDVQGMLSLYEAAYMAVRGEHILDEAIAFTTTHLQSAAPHLKSPLAEQINHALYRPLRKTLPRLEARYIMSVYQDEAFHNKTLLNFAKLDFNILLDLHKEELNELTKWWQDLDFTTKLPYARDRLVELYFWDLGTYFESQYAFGRKIMTKLNYILSIIDDTYDAYGTLEECTMFSEAVARWNIEAVDMLPDYMRIIYRTLLDTFNEIEEDMAKQRRSHCVRYAKEEIQKVIGAYYVQAKWFSEGYVPTIEEYMPIALTSCAYRFVITNSFLGMGDFATKEVFEWISGNPKVVKSASVICRLMDDMLGHEFEQKRGHVASAIECYTKQHGVSKEEAIKMFEEDVANAWKDINEELMMKPPVVARPLLGTILNLARAIDFIYKEDDGYTHSYLIKEQIASVLGDHVPF

SEQ ID NO: 847 - protein, 548 aa, Artificial Sequence
  SCVS mutant V256
MQTFNCARPTADFHPSLWKNHFLQGASDFKTVDHTATNERHEALKEEVRRMILATGRKPIQKLRLIDEVQRLGVAYHFEKEIEDMLDHIYRADPYFEAHEYNDLHTVSLHFRLLRQQGIKISCDVFEQFKDDEGRFKSSLINDVQGMLSLYEAAYMAVRGEHILDEAIAFTTTHLQSAAPHLKSPLAEQINHALYRPLRKTLPRLEARYIMSSIYDKEQSKNKTLLNFAKLDFNILLDLHKEELNELTKWWQDLDFTTKLPYARDRLVELYFWDLGTYFESQYAFGRKIMTKLNYILSIIDDTYDAYGTLEECTMFSEAVARWNIEAVDMLPDYMRIIYRTLLDTFNEIEEDMAKQRRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEDVANAWKDINEELMMKPPVVARPLLGTILNLARAIDFIYKEDDGYTHSYLIKEQIASVLGDHVPF

SEQ ID NO: 848 - protein, 548 aa, Artificial Sequence
  CVS mutant V257
MAGRGASRPTADFHPSLWKNHFLQGASDFKTVDHTATNERHEALKEEVRRMILATGRKPIQKLRLIDEVQRLGVAYHFEKEIEDMLDHIYRADPYFEAHEYNDLHTVSLHFRLLRQQGIKISCDVFEQFKDDEGRFKSSLINDVQGMLSLYEAAYMAVRGEHILDEAIAFTTTHLQSAAPHLKSPLAEQINHALYRPLRKTLPRLEARYIMSSIYDKEQSKNKTLLNFAKLDFNILLDLHKEELNELTKWWQDLDFTTKLPYARDRLVELYFWDLGTYFESQYAFGRKIMTKLNYILSIIDDTYDAYGTLEECTMFSEAVARWNIEAVDMLPDYMRIIYRTLLDTFNEIEEDMAKQRRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEDVANAWKDINEELMMKPPVVARPLLGTILNLARAIDFIYKEDDGYTHSYLIKEQIASVLGDHVPF

SEQ ID NO: 849 - protein, 548 aa, Artificial Sequence
  CVS mutant V258
MVLKSKRRPTADFHPSLWKNHFLQGASDFKTVDHTATNERHEALKEEVRRMILATGRKPIQKLRLIDEVQRLGVAYHFEKEIEDMLDHIYRADPYFEAHEYNDLHTVSLHFRLLRQQGIKISCDVFEQFKDDEGRFKSSLINDVQGMLSLYEAAYMAVRGEHILDEAIAFTTTHLQSAAPHLKSPLAEQINHALYRPLRKTLPRLEARYIMSSIYDKEQSKNKTLLNFAKLDFNILLDLHKEELNELTKWWQDLDFTTKLPYARDRLVELYFWDLGTYFESQYAFGRKIMTKLNYILSIIDDTYDAYGTLEECTMFSEAVARWNIEAVDMLPDYMRIIYRTLLDTFNEIEEDMAKQRRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEDVANAWKDINEELMMKPPVVARPLLGTILNLARAIDFIYKEDDGYTHSYLIKEQIASVLGDHVPF

SEQ ID NO: 850 - protein, 548 aa, Artificial Sequence
  CVS mutants V259 and V260
MKECTMLRPTADFHPSLWKNHFLQGASDFKTVDHTATNERHEALKEEVRRMILATGRKPIQKLRLIDEVQRLGVAYHFEKEIEDMLDHIYRADPYFEAHEYNDLHTVSLHFRLLRQQGIKISCDVFEQFKDDEGRFKSSLINDVQGMLSLYEAAYMAVRGEHILDEAIAFTTTHLQSAAPHLKSPLAEQINHALYRPLRKTLPRLEARYIMSSIYDKEQSKNKTLLNFAKLDFNILLDLHKEELNELTKWWQDLDFTTKLPYARDRLVELYFWDLGTYFESQYAFGRKIMTKLNYILSIIDDTYDAYGTLEECTMFSEAVARWNIEAVDMLPDYMRIIYRTLLDTFNEIEEDMAKQRRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEDVANAWKDINEELMMKPPVVARPLLGTILNLARAIDFIYKEDDGYTHSYLIKEQIASVLGDHVPF

SEQ ID NO: 851 - protein, 548 aa, Artificial Sequence
  CVS mutants V261 and V262
MPSGETFRPTADFHPSLWKNHFLQGASDFKTVDHTATNERHEALKEEVRRMILATGRKPIQKLRLIDEVQRLGVAYHFEKEIEDMLDHIYRADPYFEAHEYNDLHTVSLHFRLLRQQGIKISCDVFEQFKDDEGRFKSSLINDVQGMLSLYEAAYMAVRGEHILDEAIAFTTTHLQSAAPHLKSPLAEQINHALYRPLRKTLPRLEARYIMSSIYDKEQSKNKTLLNFAKLDFNILLDLHKEELNELTKWWQDLDFTTKLPYARDRLVELYFWDLGTYFESQYAFGRKIMTKLNYILSIIDDTYDAYGTLEECTMFSEAVARWNIEAVDMLPDYMRIIYRTLLDTFNEIEEDMAKQRRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEDVANAWKDINEELMMKPPVVARPLLGTILNLARAIDFIYKEDDGYTHSYLIKEQIASVLGDHVPF

SEQ ID NO: 852 - protein, 548 aa, Artificial Sequence
  CVS mutant V263
MCMTGESRPTADFHPSLWKNHFLQGASDFKTVDHTATNERHEALKEEVRRMILATGRKPIQKLRLIDEVQRLGVAYHFEKEIEDMLDHIYRADPYFEAHEYNDLHTVSLHFRLLRQQGIKISCDVFEQFKDDEGRFKSSLINDVQGMLSLYEAAYMAVRGEHILDEAIAFTTTHLQSAAPHLKSPLAEQINHALYRPLRKTLPRLEARYIMSSIYDKEQSKNKTLLNFAKLDFNILLDLHKEELNELTKWWQDLDFTTKLPYARDRLVELYFWDLGTYFESQYAFGRKIMTKLNYILSIIDDTYDAYGTLEECTMFSEAVARWNIEAVDMLPDYMRIIYRTLLDTFNEIEEDMAKQRRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEDVANAWKDINEELMMKPPVVARPLLGTILNLARAIDFIYKEDDGYTHSYLIKEQIASVLGDHVPF

SEQ ID NO: 853 - protein, 548 aa, Artificial Sequence
  CVS mutant V264
MQNLGYSRPTADFHPSLWKNHFLQGASDFKTVDHTATNERHEALKEEVRRMILATGRKPIQKLRLIDEVQRLGVAYHFEKEIEDMLDHIYRADPYFEAHEYNDLHTVSLHFRLLRQQGIKISCDVFEQFKDDEGRFKSSLINDVQGMLSLYEAAYMAVRGEHILDEAIAFTTTHLQSAAPHLKSPLAEQINHALYRPLRKTLPRLEARYIMSSIYDKEQSKNKTLLNFAKLDFNILLDLHKEELNELTKWWQDLDFTTKLPYARDRLVELYFWDLGTYFESQYAFGRKIMTKLNYILSIIDDTYDAYGTLEECTMFSEAVARWNIEAVDMLPDYMRIIYRTLLDTFNEIEEDMAKQRRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEDVANAWKDINEELMMKPPVVARPLLGTILNLARAIDFIYKEDDGYTHSYLIKEQIASVLGDHVPF

SEQ ID NO: 854 - protein, 548 aa, Artificial Sequence
  CVS mutant V265
MLNSIDSRPTADFHPSLWKNHFLQGASDFKTVDHTATNERHEALKEEVRRMILATGRKPIQKLRLIDEVQRLGVAYHFEKEIEDMLDHIYRADPYFEAHEYNDLHTVSLHFRLLRQQGIKISCDVFEQFKDDEGRFKSSLINDVQGMLSLYEAAYMAVRGEHILDEAIAFTTTHLQSAAPHLKSPLAEQINHALYRPLRKTLPRLEARYIMSSIYDKEQSKNKTLLNFAKLDFNILLDLHKEELNELTKWWQDLDFTTKLPYARDRLVELYFWDLGTYFESQYAFGRKIMTKLNYILSIIDDTYDAYGTLEECTMFSEAVARWNIEAVDMLPDYMRIIYRTLLDTFNEIEEDMAKQRRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEDVANAWKDINEELMMKPPVVARPLLGTILNLARAIDFIYKEDDGYTHSYLIKEQIASVLGDHVPF

SEQ ID NO: 855 - protein, 548 aa, Artificial Sequence
  CVS mutant V266
MPDRTGPRPTADFHPSLWKNHFLQGASDFKTVDHTATNERHEALKEEVRRMILATGRKPIQKLRLIDEVQRLGVAYHFEKEIEDMLDHIYRADPYFEAHEYNDLHTVSLHFRLLRQQGIKISCDVFEQFKDDEGRFKSSLINDVQGMLSLYEAAYMAVRGEHILDEAIAFTTTHLQSAAPHLKSPLAEQINHALYRPLRKTLPRLEARYIMSSIYDKEQSKNKTLLNFAKLDFNILLDLHKEELNELTKWWQDLDFTTKLPYARDRLVELYFWDLGTYFESQYAFGRKIMTKLNYILSIIDDTYDAYGTLEECTMFSEAVARWNIEAVDMLPDYMRIIYRTLLDTFNEIEEDMAKQRRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEDVANAWKDINEELMMKPPVVARPLLGTILNLARAIDFIYKEDDGYTHSYLIKEQIASVLGDHVPF

SEQ ID NO: 856 - protein, 549 aa, Artificial Sequence; identical to SEQ ID NO: 744
  CVS mutant V267

SEQ ID NO: 857 - protein, 548 aa, Artificial Sequence
  CVS mutant V227
MSSGETFRPTADFHPSLWRNHFLQGASDFKTVDHTATNERHEALKEEVRRMITDAEDQPIQKLRLIDEVQRLGVAYHFEKEIEDAIQQLCPIHIDSDKADLHTVSLHFRLLRQQGIKISCDVFEQFKDDEGRFKSSLINDVQGMLSLYEAAYMAVRGEHILDEAIAFTTTHLQSLVAQDHVTPRLAEQINHALYRPLRKTLPRLEARYHMSRIDSTSDDLVNKTLLNFAKLDFNILLDLHKEELNELTKWWQDLDFTTKLPYARDRLVELYFWDLGTYFESQYAFGRKIMTKLNYILSIIDDTYDAYGTLEECTMFSEAVARWNIEAVDMLPDYMRIIYRTLLDTFNEIEEDMAKQRRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 858 - protein, 549 aa, Artificial Sequence
  CVS mutant V268
MSSGETFRPTADFHPSLWKNHFLQGASDFKTVDHTATNERHEALKEEVRRMILATGRKPIQKLRLIDEVQRLGVAYHFEKEIEDMLDHIYRADPYFEAHEYNDLHTVSLHFRLLRQQGIKISCDVFEQFKDDEGRFKSSLINDVQGMLSLYEAAYMAVRGEHILDEAIAFTTTHLQSAAPHLKSPLAEQINHALYRPLRKTLPRLEARYEMSRIDSTSDDLVNKTLLNFAKLDFNILLDLHKEELNELTKWWQDLDFTTKLPYARDRLVELYFWDLGTYFESQYAFGRKIMTKLNYILSIIDDTYDAYGTLEECTMFSEAVARWNIEAVDMLPDYMRIIYRTLLDTFNEIEEDMAKQRRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEDVANAWKDINEELMMKPPVVARPLLGTILNLARAIDFIYKEDDGYTHSYLIKEQIASVLGDHVPF

SEQ ID NO: 859 - protein, 549 aa, Artificial Sequence
  CVS mutant V269
MSSGETFRPTADFHPSLWRNHFLQGASDFKTVDHTATNERHEALKEEVRRMILATGRKPIQKLRLIDEVQRLGVAYHFEKEIEDMLDHIYRADPYFEAHEYNDLHTVSLHFRLSRQQGIKISCDVFEQFKDDEGRFKSSLINDVQGMLSLYEAAYMAVRGEHILDEAIAFTTTHLQSAAPHLKSPLAEQINHALYRPLRKTLPRLEARYEMSRIDSTSDDLVNKTLLNFAKLDFNILLDLHKEELNELTKWWQDLDFTTKLPYARDRLVELYFWDLGTYFESQYAFGRKIMTKLNYILSIIDDTYDAYGTLEECTMFSEAVARWNIEAVDMLPDYMRIIYRTLLDTFNEIEEDMAKQRRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEDVANAWKDINEELMMKPPVVARPLLGTILNLARAIDFIYKEDDGYTHSYLIKEQIASVLGDHVPF

SEQ ID NO: 860 - protein, 549 aa, Artificial Sequence
  CVS mutant V270
MSSGETFRPTADFHPSLWKNHFLQGASDFKTVDHTATNERHEALKEEVRRMILATGRKPIQKLRLIDEVQRLGVAYHFEKEIEDMLDHIYRADPYFEAHEYNDLHTVSLHFRLLRQQGIKISCDVFEQFKDDEGRFKSSLINDVQGMLSLYEAAYMAVRGEHILDEAIAFTTTHLQSAAPHLKSPLAEQINHALYRPLRKTLPRLEARYLMSRIDSTSDDLVNKTLLNFAKLDFNILLDLHKEELNELTKWWQDLDFTTKLPYARDRLVELYFWDLGTYFESQYAFGRKIMTKLNYILSIIDDTYDAYGTLEECTMFSEAVARWNIEAVDMLPDYMRIIYRTLLDTFNEIEEDMAKQRRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEDVANAWKDINEELMMKPPVVARPLLGTILNLARAIDFIYKEDDGYTHSYLIKEQIASVLGDHVPF

SEQ ID NO: 861 - protein, 549 aa, Artificial Sequence
  CVS mutant V271
MSSGETFRPTADFHPSLWKNHFLQGASDFKTVDHTATNERHEALKEEVRRMILATGRKPIQKLRLIDEVQRLGVAYHFEKEIEDMLDHIYRADPYFEAHEYNDLHTVSLHFRLLRQQGIKISCDVFEQFKDDEGRFKSSLINDVQGMLSLYEAAYMAVRGEHILDEAIAFTTTHLQSAAPHLKSPLAEQINHALYRPLRKTLPRLEARYTMSRIDSTSDDLVNKTLLNFAKLDFNILLDLHKEELNELTKWWQDLDFTTKLPYARDRLVELYFWDLGTYFESQYAFGRKIMTKLNYILSIIDDTYDAYGTLEECTMFSEAVARWNIEAVDMLPDYMRIIYRTLLDTFNEIEEDMAKQRRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEDVANAWKDINEELMMKPPVVARPLLGTILNLARAIDFIYKEDDGYTHSYLIKEQIASVLGDHVPF

SEQ ID NO: 862 - protein, 549 aa, Artificial Sequence
  CVS mutant V272
MSSGETFRPTADFHPSLWKNHFLQGASDFKTVDHTATNERHEALKEEVRRMILATGRKPIQKLRLIDEVQRLGVAYHFEKEIEDMLDHIYRADPYFEAHEYNDLHTVSLHFRLLRQQGIKISCDVFEQFKDDEGRFKSSLINDVQGMLSLYEAAYMAVRGEHILDEAIAFTTTHLQSAAPHLKSPLAEQINHALYRPLRKTLPRLEARYIMSAFLACGRRPTNKTLLNFAKLDFNILLDLHKEELNELTKWWQDLDFTTKLPYARDRLVELYFWDLGTYFEPQYAFGRKIMTKLNYILSIIDDTYDAYGTLEECTMFSEAVARWNIEAVDMLPDYMRIIYRTLLDTFNEIEEDMAKQRRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 863 - protein, 548 aa, Artificial Sequence
  CVS mutant V273
MATSHSQRPTADFHPSLWKNHFLQGASDFKTVDHTATNERHEALKEEVRRMILATGRKPIQKLRLIDEVQRLGVAYHFEKEIEDMLDHIYRADPYFEAHEYNDLHTVSLHFRLLRQQGIKISCDVFEQFKDDEGRFKSSLINDVQGMLSLYEAAYMAVRGEHILDEAIAFTTTHLQSAAPHLKSPLAEQINHALYRPLRKTLPRLEARYIMSSIYDKEQSKNKTLLNFAKLDFNILLDLHKEELNELTKWWQDLDFTTKLPYARDRLVELYFWDLGTYFESQYAFGRKIMTKLNYILSIIDDTYDAYGTLEECTMFSEAVARWNTEAVDMLPDYMRIIYRTLLDTFNEIEEDMAKQRRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEDVANAWKDINEELMMKPPVVARPLLGTILNLARAIDFIYKEDDGYTHSYLIKEQIASVLGDHVPF

SEQ ID NO: 864 - protein, 559 aa, Artificial Sequence
  CVS mutant V274
MSTQVSASSLAQIPQPKNRPVANFHPNIWGDQFITYTPEDKVTRACKEEQIEALKEEVRRMILATGRKPIQKLRLIDEVQRLGVAYHFEKEIEDMLDHIYRADPYFEAHEYNDLHTVSLHFRLLRQQGIKISCDVFEQFKDDEGRFKSSLINDVQGMLSLYEAAYMAVRGEHILDEAIAFTTTHLQSAAPHLKSPLAEQINHALYRPLRKTLPRLEARYIMSRIDSTSDDLVNKTLLNFAKLDFNILLDLHKEELNELTKWWQDLDFTTKLPYARDRLVELYFWDLGTYFESQYAFGRKIMTKLNYILSIIDDTYDAYGTLEECTMFSEAVARWNIEAVDMLPDYMRIIYRTLLDTFNEIEEDMAKQRRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEDVANAWKDINEELMMKPPVVARPLLGTILNLARAIDFIYKEDDGYTHSYLIKEQIASVLGDHVPF

SEQ ID NO: 865 - protein, 550 aa, Artificial Sequence
  CVS mutant V275
MSSGETFRPTADFHPSLWRNHFLQGASDFKTVDHTATNERHEALKEEVRRMITDAEDQPIQKLRLIDEVQRLGVAYHFEKEIEDALQHICNNFHDCNDMDGDLHTVSLHFRLLRQQGIKISCDVFEQFKDDEGRFKSSLINDVQGMLSLYEAAYMAVRGEHILDEAIAFTTTHLQSLVAQDHVTPRLAEQINHALYRPLRKTLPRLEARYIMSRIDSTSDDLVNKTLLNFAKLDFNILLDLHKEELNELTKWWQDLDFTTKLPYARDRLVELYFWDLGTYFESQYAFGRKIMTKLNYILSIIDDTYDAYGTLEECTMFSEAVARWNIEAVDMLPDYMRIIYRTLLDTFNEIEEDMAKQRRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 866 - protein, 550 aa, Artificial Sequence
  CVS mutant V276
MSSGETFRPTADFHPSLWRNHFLQGASDFKTVDHTATNERHEALKEEVRRMITDAEDQPIQKLRLIDEVQRLGVAYHFEKEIEDALQHICNSFHDCNDMDGDLHTVSLHFRLLRQQGIKISCDVFEQFKDDEGRFKSSLINDVQGMLSLYEAAYMAVRGEHILDEAIAFTTTHLQSLVAQDHVTPRLAEQINHALYRPLRKTLPRLEARYIMSRIDSTSDDLVNKTLLNFAKLDFNILLDLHKEELNELTKWWQDLDFTTKLPYARDRLVELYFWDLGTYFESQYAFGRKIMTKLNYILSIIDDTYDAYGTLEECTMFSEAVARWNIEAVDMLPDYMRIIYRTLLDTFNEIEEDMAKQRRSHCVRYAKEEIQKVIGAYYVQAKWFSEGCVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 867 - protein, 39 aa, Citrus sinensis
  CVS3-41
SGETFRPTADFHPSLWRNHFLKGASDFKTVDHTATQERH

SEQ ID NO: 868 - protein, 6 aa, Citrus sinensis
  CVS53-58
TDAEDK

SEQ ID NO: 869 - protein, 15 aa, Citrus sinensis
  CVS85-99
AIQKLCPIYIDSNRA

SEQ ID NO: 870 - protein, 11 aa, Citrus sinensis
  CVS174-184
SLVAQDHVTPK

SEQ ID NO: 871 - protein, 10 aa, Citrus sinensis
  CVS212-221
MINSTSDHLY

SEQ ID NO: 872 - protein, 49 aa, Vitis vinifera
  Vitis vinifera amino acids 3-51
TQVSASSLAQIPQPKNRPVANFHPNIWGDQFITYTPEDKVTRACKEEQI

SEQ ID NO: 873 - protein, 6 aa, Nicotiana tabacum
  TEAS 58-63
LATGRK

SEQ ID NO: 874 - protein, 18 aa, Hyoscyamus muticus
  HPS 93-110
MLDHIYRADPYFEAHEYN

SEQ ID NO: 875 - protein, 17 aa, Vitis vinifera
  Vitis vinifera 96-112
ALQHICNSFHDCNDMDG

SEQ ID NO: 876 - protein, 17 aa, Artificial Sequence
  Vitis vinifera 96-112 with S103N
ALQHICNNFHDCNDMDG

SEQ ID NO: 877 - protein, 9 aa, Hyoscyamus muticus
  HPS 185-193
SAAPHLKSP

SEQ ID NO: 878 - protein, 8 aa, Hyoscyamus muticus
  HPS 221-228
IYEEEEFK

SEQ ID NO: 879 - protein, 8 aa, Artificial Sequence
  HPS 221-228 with E226G mutation
IYEEEGFK

SEQ ID NO: 880 - protein, 9 aa, Nicotiana tabacum
  TEAS 213-221
SIYDKEQSK

SEQ ID NO: 881 - protein, 8 aa, Vitis vinifera
  Vitis vinifera 223-230
VYQDEAFH

SEQ ID NO: 882 - protein, 589 aa, Chamaecyparis nootkatensis
  valencene synthase
MAEMFNGNSSNDGSSCMPVKDALRRTGNHHPNLWTDDFIQSLNSPYSDSSYHKHREILIDEIRDMFSNGEGDEFGVLENIWFVDVVQRLGIDRHFQEEIKTALDYIYKFWNHDSIFGDLNMVALGFRILRLNRYVASSDVFKKFKGEEGQFSGFESSDQDAKLEMMLNLYKASELDFPDEDILKEARAFASMYLKHVIKEYGDIQESKNPLLMEIEYTFKYPWRCRLPRLEAWNFIHIMRQQDCNISLANNLYKIPKIYMKKILELAILDFNILQSQHQHEMKLISTWWKNSSAIQLDFFRHRHIESYFWWASPLFEPEFSTCRINCTKLSTKMFLLDDIYDTYGTVEELKPFTTTLTRWDVSTVDNHPDYMKIAFNFSYEIYKEIASEAERKHGPFVYKYLQSCWKSYIEAYMQEAEWIASNHIPGFDEYLMNGVKSSGMRILMIHALILMDTPLSDEILEQLDIPSSKSQALLSLITRLVDDVKDFEDEQAHGEMASSIECYMKDNHGSTREDALNYLKIRIESCVQELNKELLEPSNMHGSFRNLYLNVGMRVIFFMLNDGDLFTHSNRKEIQDAITKFFVEPIIP

SEQ ID NO: 883 - protein, 589 aa, Chamaecyparis nootkatensis; identical to SEQ ID NO: 882
  valencene synthase

SEQ ID NO: 884 - DNA, 1722 bp, Chamaecyparis nootkatensis
  valencene synthase
atgcccgtgaaggacgcccttcgtcggactggaaatcatcatcctaacttgtggactgatgatttcatacagtccctcaattctccatattcggattcttcataccataaacatagggaaatactaattgatgagattcgtgatatgttttctaatggagaaggcgatgagttcggtgtacttgaaaatatttggtttgttgatgttgtacaacgtttgggaatagatcgacattttcaagaggaaatcaaaactgcacttgattatatctacaagttctggaatcatgatagtatttttggcgatctcaacatggtggctctaggatttcggatactacgactgaatagatatgtcgcttcttcagatgtttttaaaaagttcaaaggtgaagaaggacaattctctggttttgaatctagcgatcaagatgcaaaattagaaatgatgttaaatttatataaagcttcagaattagattttcctgatgaagatatcttaaaagaagcaagagcgtttgcttctatgtacctgaaacatgttatcaaagaatatggtgacatacaagaatcaaaaaatccacttctaatggagatagagtacacttttaaatatccttggagatgtaggcttccaaggttggaggcttggaactttattcatataatgagacaacaagattgcaatatatcacttgccaataacctttataaaattccaaaaatatatatgaaaaagatattggaactagcaatactggacttcaatattttgcagtcacaacatcaacatgaaatgaaattaatatccacatggtggaaaaattcaagtgcaattcaattggatttctttcggcatcgtcacatagaaagttatttttggtgggctagtccattatttgaacctgagttcagtacatgtagaattaattgtaccaaattatctacaaaaatgttcctccttgacgatatttatgacacatatgggactgttgaggaattgaaaccattcacaacaacattaacaagatgggatgtttccacagttgataatcatccagactacatgaaaattgctttcaatttttcatatgagatatataaggaaattgcaagtgaagccgaaagaaagcatggtccctttgtttacaaataccttcaatcttgctggaagagttatatcgaggcttatatgcaagaagcagaatggatagcttctaatcatataccaggttttgatgaatacttgatgaatggagtaaaaagtagcggcatgcgaattctaatgatacatgcactaatactaatggatactcctttatctgatgaaattttggagcaacttgatatcccatcatccaagtcgcaagctcttctatcattaattactcgactagtggatgatgtcaaagactttgaggatgaacaagctcatggggagatggcatcaagtatagagtgctacatgaaagacaaccatggttctacaagggaagatgctttgaattatctcaaaattcgtatagagagttgtgtgcaagagttaaataaggagcttctcgagccttcaaatatgcatggatcttttagaaacctatatctcaatgttggcatgcgagtaatattttttatgctcaatgatggtgatctctttacacactccaatagaaaagagatacaagatgcaataacaaaattttttgtggaaccaatcattccatag

SEQ ID NO: 885 - DNA, 1770 bp, Chamaecyparis nootkatensis
  valencene synthase
atggctgaaatgtttaatggaaattccagcaatgatggaagttcttgcatgcccgtgaaggacgcccttcgtcggactggaaatcatcatcctaacttgtggactgatgatttcatacagtccctcaattctccatattcggattcttcataccataaacatagggaaatactaattgatgagattcgtgatatgttttctaatggagaaggcgatgagttcggtgtacttgaaaatatttggtttgttgatgttgtacaacgtttgggaatagatcgacattttcaagaggaaatcaaaactgcacttgattatatctacaagttctggaatcatgatagtatttttggcgatctcaacatggtggctctaggatttcggatactacgactgaatagatatgtcgcttcttcagatgtttttaaaaagttcaaaggtgaagaaggacaattctctggttttgaatctagcgatcaagatgcaaaattagaaatgatgttaaatttatataaagcttcagaattagattttcctgatgaagatatcttaaaagaagcaagagcgtttgcttctatgtacctgaaacatgttatcaaagaatatggtgacatacaagaatcaaaaaatccacttctaatggagatagagtacacttttaaatatccttggagatgtaggcttccaaggttggaggcttggaactttattcatataatgagacaacaagattgcaatatatcacttgccaataacctttataaaattccaaaaatatatatgaaaaagatattggaactagcaatactggacttcaatattttgcagtcacaacatcaacatgaaatgaaattaatatccacatggtggaaaaattcaagtgcaattcaattggatttctttcggcatcgtcacatagaaagttatttttggtgggctagtccattatttgaacctgagttcagtacatgtagaattaattgtaccaaattatctacaaaaatgttcctccttgacgatatttatgacacatatgggactgttgaggaattgaaaccattcacaacaacattaacaagatgggatgtttccacagttgataatcatccagactacatgaaaattgctttcaatttttcatatgagatatataaggaaattgcaagtgaagccgaaagaaagcatggtccctttgtttacaaataccttcaatcttgctggaagagttatatcgaggcttatatgcaagaagcagaatggatagcttctaatcatataccaggttttgatgaatacttgatgaatggagtaaaaagtagcggcatgcgaattctaatgatacatgcactaatactaatggatactcctttatctgatgaaattttggagcaacttgatatcccatcatccaagtcgcaagctcttctatcattaattactcgactagtggatgatgtcaaagactttgaggatgaacaagctcatggggagatggcatcaagtatagagtgctacatgaaagacaaccatggttctacaagggaagatgctttgaattatctcaaaattcgtatagagagttgtgtgcaagagttaaataaggagcttctcgagccttcaaatatgcatggatcttttagaaacctatatctcaatgttggcatgcgagtaatattttttatgctcaatgatggtgatctctttacacactccaatagaaaagagatacaagatgcaataacaaaattttttgtggaaccaatcattccatag

SEQ ID NO: 886 - protein, 548 aa, Citrus sinensis
  Valencene synthase A517I, I518V
MSSGETFRPTADFHPSLWRNHFLKGASDFKTVDHTATQERHEALKEEVRRMITDAEDKPVQKLRLIDEVQRLGVAYHFEKEIGDAIQKLCPIYIDSNRADLHTVSLHFRLLRQQGIKISCDVFEKFKDDEGRFKSSLINDVQGMLSLYEAAYMAVRGEHILDEAIAFTTTHLKSLVAQDHVTPKLAEQINHALYRPLRKTLPRLEARYFMSMINSTSDHLCNKTLLNFAKLDFNILLELHKEELNELTKWWKDLDFTTKLPYARDRLVELYFWDLGTYFEPQYAFGRKIMTQLNYILSIIDDTYDAYGTLEELSLFTEAVQRWNIEAVDMLPEYMKLIYRTLLDAFNEIEEDMAKQGRSHCVRYAKEENQKVIGAYSVQAKWFSEGYVPTIEEYMPIALTSCAYTFVITNSFLGMGDFATKEVFEWISNNPKVVKAASVICRLMDDMQGHEFEQKRGHVASAIECYTKQHGVSKEEAIKMFEEEVANAWKDINEELMMKPTVVARPLLGTILNLARIVDFIYKEDDGYTHSYLIKDQIASVLGDHVPF

SEQ ID NO: 887 - protein, 557 aa, Artificial Sequence
  CVS mutant V277
MSTQVSASSLAQIPQPKNRPVANFHPNIWGDQFITYTPEDKVTRACKEEQIEALKEEVRRMILATGRKPIQKLRLIDEVQRLGVAYHFEKEIEDMLDHIYRADPYFEAHEYNDLHTVSLHFRLLRQQGIKISCDVFEQFKDDEGRFKSSLINDVQGMLSLYEAAYMAVRGEHILDEAIAFTTTHLQSAAPHLKSPLAEQINHALYRPLRKTLPRLEARYIMSVYQDEAFHNKTLLNFAKLDFNILLDLHKEELNELTKWWQDLDFTTKLPYARDRLVELYFWDLGTYFESQYAFGRKIMTKLNYILSIIDDTYDAYGTLEECTMFSEAVARWNIEAVDMLPDYMRIIYRTLLDTFNEIEEDMAKQRRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEDVANAWKDINEELMMKPPVVARPLLGTILNLARAIDFIYKEDDGYTHSYLIKEQIASVLGDHVPF

SEQ ID NO: 888 - protein, 549 aa, Artificial Sequence
  CVS mutant V278
MSSGETFRPTADFHPSLWKNHFLQGASDFKTVDHTATNERHEALKEEVRRMILATGRKPIQKLRLIDEVQRLGVAYHFEKEIEDMLDHIYRADPYFEAHEYNDLHTVSLHFRLLRQQGIKISCDVFEQFKDDEGRFKSSLINDVQGMLSLYEAAYMAVRGEHILDEAIAFTTTHLQSAAPHLKSPLAEQINHALYRPLRKTLPRLEARYIMSRIVSTSDDLVNKTLLNFAKLDFNILLDLHKEELNELTKWWQDLDFTTKLPYARDRLVELYFWDLGTYFESQYAFGRKIMTKLNYILSIIDDTYDAYGTLEECTMFSEAVARWNIEAVDMLPDYMRIIYRTLLDTFNEIEEDMAKQRRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEDVANAWKDINEELMMKPPVVARSLLGTILNLARAIDFIYKEDDGYTHSYLIKEQIASVLGDHVPF

SEQ ID NO: 889 - protein, 549 aa, Artificial Sequence
  CVS mutant V279
MSSGETFRPTADFHPSLWKNHFLQGASDFKTVDHTATNERHEALKEEVRRMILATGRKPIQKLRLIDEVQRLGVAYHFEKEIEDMLDHIYRADPYFEAHEYNDLHTVSLHFRLLRQQGIKISCDVFEQFKDDEGRFKSSLINDVQGMLSLYEAAYMAVRGEHILDEAIAFTTTHLQSAAPHLKSPLAEQINHALYRPLRKTLPRLEARYIMSRIDSTSDDLVNKTLLNFAKLDFNILLDLHKEELNELTKWWQDLDFATKLPYARDRLVELYFWDLGTYFESQYAFGRKIMTKLNYILSIIDDTYDAYGTLEECTMFSEAVARWNIEAVDMLPDYMRIIYRTLLDTFNEIEEDMAKQRRSHCVRYAKEEIQKVIGAYYVQAKWFSEGYVPTIEEYMPIALTSCAYRFVITSSFLGMGDFATKEVFEWISGNPKVVKSASVICRLMDDMQGHEFEQKRGHVASAIECYTKQHGVSKEEAIKMFEEDVANAWKDINEELMMKPPVVARPLLGTILNLARAIDFIYKEDDGYTHSYLIKEQIASVLGDHVPF

SEQ ID NO: 890 - protein, 549 aa, Artificial Sequence
  CVS mutant V280
MSSGETFRPTADFHPSLWKNHFLQGASDFKTVDHTATNERHEALKEEVRRMILATGRKPVQKLRLIDELQRLGVAYHFEKEIEDMLDHIYRADPYFEAHEYNDLHTVSLHFRLLRQQGIKISCDVFEQFKDDEGRFKSSLINDVQGMLSLYEAAYMAVRGEHILDEAIAFTTTHLQSAAPHLKSPLAEQINHALYRPLRKTLPRLEARYIMSRIDSTSDDLVNKTLLNFAKLDFNILLDLHKEELNELTKWWQDLDFTTKLPYARDRLVELYFWDLGTYFESQYAFGRKIMTKLNYILSIIDDTYDAYGTLEECTMFSEAVARWNIEAVDMLPDYMRIIYRTLLDTFNEIEEDMAKQRRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEDVANAWKDINEELMMKPPVVARPLLGTILNLARAIDFIYKEDDGYTHSYLIKEQIASVLGDHVPF

SEQ ID NO: 891 - DNA, 1674 bp, Artificial Sequence
  CVS mutant V277
atgtctactcaagtctcagcatcttctctagcccagattccccaacccaaaaatcgtcctgtggcaaactttcaccccaacatttggggtgaccaatttatcacctacactcctgaagacaaggttactcgtgcctgcaaagaggagcagattgaagctttgaaggaagaagttagaagaatgattttagcaaccggaaggaaaccaattcaaaaattgagattgattgatgaagttcaaagattgggtgttgcttaccattttgaaaaagaaattgaagatatgttggatcacatttacagagctgatccttattttgaggctcatgaatacaatgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatctgcagctccacatttgaagtcacctttggctgaacaaattaaccatgctttgtatagaccattgagaaaaactttgccaagattggaagcaagatacattatgtcagtctaccaagatgaagctttccataacaagactttgttaaatttcgctaagttggatttcaatattttgttggatttgcataaagaagaattgaacgaattgactaaatggtggcaagatttggattttactactaaattgccatatgctagagatagattggttgaactgtacttttgggatttggggacttattttgaatcacaatacgcttttggtagaaaaatcatgactaaattgaactacattttgtccattattgatgatacctacgatgcttacggtactttggaagaatgcacgatgttcagtgaagctgttgctcgttggaacattgaagctgttgatatgttgccagattatatgcgaattatctacagaactttgttggatacattcaacgaaatagaagaggatatggctaaacaacggagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagatgttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatcgcatctgttttgggtgatcatgttccattttaa

SEQ ID NO: 892 - DNA, 1650 bp, Artificial Sequence
  CVS mutant V278
atgtcatctggtgaaacttttagaccaactgctgattttcatccatctttgtggaaaaatcattttttgcaaggtgcatcagattttaagactgttgatcatacagctacaaatgaaagacatgaagctttgaaggaagaagttagaagaatgattttagcaaccggaaggaaaccaattcaaaaattgagattgattgatgaagttcaaagattgggtgttgcttaccattttgaaaaagaaattgaagatatgttggatcacatttacagagctgatccttattttgaggctcacgaatacaatgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagcagcttatatggctgttagaggtgaacatattttggatgaagctattgcatttactactactcatttgcaatctgcagctccacatttgaagtcacctttggctgaacaaattaaccatgctttgtatagaccattgaggaaaactttgccaagattggaagcaagatacattatgtcaagaattgtttctacttctgatgatttggttaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttggggacttattttgaatcacaatacgcttttggtagaaaaatcatgactaaattgaactacattttgtccattattgatgatacctacgatgcttacggtactttggaagaatgcacgatgttcagtgaagctgttgctcgttggaacattgaagctgttgatatgttgccagattatatgcgaattatctacagaactttgttggatacattcaacgaaatagaagaggatatggctaaacaacggagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagatgttgctaacgcttggaaggatatcaatgaagaattaatgatgaaaccaccagttgttgctagatcattgttaggtactattttgaatttggctagagctatcgattttatctataaagaagatgacggttacactcattcttatttgattaaggaacaaatagcatctgttttgggtgatcatgttccattttaa

SEQ ID NO: 893 - DNA, 1650 bp, Artificial Sequence
  CVS mutant V279
atgtcatctggtgaaacttttagaccaactgctgattttcatccatctttgtggaaaaatcattttttgcaaggtgcatcagattttaagactgttgatcatacagctacaaatgaaagacatgaagctttgaaggaagaagttagaagaatgattttagcaaccggaaggaaaccaattcaaaaattgagattgattgatgaagttcaaagattgggtgttgcttaccattttgaaaaagaaattgaagatatgttggatcacatttacagagctgatccttattttgaggctcatgaatacaatgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatctgcagctccacatttgaagtcacctttggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtggcaagatttggattttgctactaaattgccatatgctagagatagattggttgaattgtacttttgggatttggggacttattttgaatcacaatacgcttttggtagaaaaatcatgactaaattgaactacattttgtccattattgatgatacctacgatgcttacggtactttggaagaatgcacgatgttcagtgaagctgttgctcgttggaacattgaagctgttgatatgttgccagattatatgcgaattatctacagaactttgttggatacattcaacgaaatagaagaggatatggctaaacaacggagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccagttcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagatgttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 894 - DNA, 1650 bp, Artificial Sequence
  CVS mutant V280
atgtcatctggtgaaacttttagaccaactgctgattttcatccatctttgtggaaaaatcattttttgcaaggtgcatcagattttaagactgttgatcatacagctacaaatgaaagacatgaagctttgaaggaagaagttagaagaatgattttagcaaccggaaggaaaccagttcaaaaattgagattgattgatgaacttcaaagattgggtgttgcttaccattttgaaaaagaaattgaagatatgttggatcacatttacagagctgatccttattttgaggctcatgaatacaatgatttgcataccgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatctgcagctccacatttgaagtcacctttggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttggggacttattttgaatcacaatacgcttttggtagaaaaatcatgactaaattgaactacattttgtccattattgatgatacctacgatgcttacggtactttggaagaatgcacgatgttcagtgaagctgttgctcgttggaacattgaagctgttgatatgttgccagattatatgcgaattatctacagaactttgttggatacattcaacgaaatagaagaggatatggctaaacaacggagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagatgttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 895 - protein, 547 aa, Artificial Sequence
  CVS mutant V281
MSSGETFRPTADFHPSLWKNHFLPGASDFKTVDHTATYERHEALKEEVRRMILATGRKPIQKLRLIDEVQRLGVAYHFEKEIEDMLDHIYRADPYFEAHEYNDLHTVSLHFRLLRQQGIKISCDVFEQFKDDEGRFKSSLINDVQGMLSLYEAAYMAVRGEHILDEAIAFTTTHLQSAAPHLKSPLAEQINHALYRPLRKTLPRLEARYIMSVYQDEAFHNKTLLNFAKLDFNILLDLHKEELNELTKWWQDLDFTTKLPYARDRLVELYFWDLGTYFESQYAFGRKIMTKLNYILSIIDDTYDAYGTLEECTMFSEAVARWNIEAVDMLPDYMRIIYRTLLDTFNEIEEDMAKQRRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEDVANAWKDINEELMMKPPVVARPLLGTILNLARAIDFIYKEDDGYTHSYLIKEQIASVLGDHVPF

SEQ ID NO: 896 - DNA, 1644 bp, Artificial Sequence
  CVS mutant V281
atgtcatctggtgaaacttttagaccaactgctgatttccatccatctttgtggaaaaatcattttttgccaggtgcatcagattttaagactgttgatcatacagctacatatgaaagacatgaagctttgaaggaagaagttagaagaatgattttagcaaccggaaggaaaccaattcaaaaattgagattgattgatgaagttcaaagattgggtgttgcttaccattttgaaaaagaaattgaagatatgttggatcacatttacagagctgatccttattttgaggctcatgaatacaatgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatctgcagctccacatttgaagtcacctttggctgaacaaattaaccatgctttgtatagaccattgagaaaaactttgccaagattggaagcaagatacattatgtcagtctaccaagatgaagctttccataacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttggggacttattttgaatcacaatacgcttttggtagaaaaatcatgactaaattgaactacattttgtccattattgatgatacctacgatgcttacggtactttggaagaatgcacgatgttcagtgaagctgttgctcgttggaacattgaagctgttgatatgttgccagattatatgcgaattatctacagaactttgttggatacattcaacgaaatagaagaggatatggctaaacaacggagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagatgttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 897 - DNA, 56 bp, Artificial Sequence
  oligo 21-73.39
aggtagatctcwttgtgtaagatacgctaaagaagaaattcamaaggttattggtg

SEQ ID NO: 898 - DNA, 30 bp, Artificial Sequence
  oligo 21-71.41
gctcgttggaacattgaagctgttgacatg

SEQ ID NO: 899 - DNA, 30 bp, Artificial Sequence
  oligo 21-71.42
catgtcaacagcttcaatgttccaacgagc

SEQ ID NO: 900 - DNA, 48 bp, Artificial Sequence; identical to SEQ ID NO: 340
  oligo 21-108.1
  variation (16)...(33): n = a or c or t or g

SEQ ID NO: 901 - DNA, 48 bp, Artificial Sequence; identical to SEQ ID NO: 341
  oligo 21-108.2
  variation (16)...(33): n = a or c or t or g

SEQ ID NO: 902 - DNA, 73 bp, Artificial Sequence
  oligo 21-140.1
  variation (22)...(51): n = a or c or t or g
gaagcaagatacattatgtcannnnnnnnnnnnnnnnnnnnnnnnnnnnnnaacaagactttgttaaatttcg

SEQ ID NO: 903 - DNA, 73 bp, Artificial Sequence
  oligo 21-140.2
  variation (23)...(52): n = a or c or t or g
cgaaatttaacaaagtcttgttnnnnnnnnnnnnnnnnnnnnnnnnnnnnnntgacataatgtatcttgcttc

SEQ ID NO: 904 - DNA, 59 bp, Artificial Sequence
  oligo revAA2-7rnd
  variation (20)...(37): n = a or c or t or g
gaaaatcagcagttggtctnnnnnnnnnnnnnnnnnncatttttttaaatggtaccgag

SEQ ID NO: 905 - DNA, 40 bp, Artificial Sequence
  oligo 21-145.13
cgccccgtcgccgacttctccccatctttgtggaaaaatc

SEQ ID NO: 906 - DNA, 40 bp, Artificial Sequence
  oligo 21-145.14
gatttttccacaaagatggggagaagtcggcgacggggcg

SEQ ID NO: 907 - DNA, 40 bp, Artificial Sequence
  oligo 21-145.15
cgtcctgtggcaaactttcacccatctttgtggaaaaatc

SEQ ID NO: 908 - DNA, 40 bp, Artificial Sequence
  oligo 21-145.16
gatttttccacaaagatgggtgaaagtttgccacaggacg

SEQ ID NO: 909 - DNA, 40 bp, Artificial Sequence
  oligo 21-145.17
cgccctgttgcagatttttctccatctttgtggaaaaatc

SEQ ID NO: 910 - DNA, 40 bp, Artificial Sequence
  oligo 21-145.18
gatttttccacaaagatggagaaaaatctgcaacagggcg

SEQ ID NO: 911 - DNA, 40 bp, Artificial Sequence
  oligo 21-145.25
gaaaagtatgctcaagagattgaagctttgaaggaagaag

SEQ ID NO: 912 - DNA, 40 bp, Artificial Sequence
  oligo 21-145.26
cttcttccttcaaagcttcaatctcttgagcatacttttc

SEQ ID NO: 913 - DNA, 40 bp, Artificial Sequence
  oligo 21-145.27
gcctgcaaagaggagcagattgaagctttgaaggaagaag

SEQ ID NO: 914 - DNA, 40 bp, Artificial Sequence
  oligo 21-145.28
cttcttccttcaaagcttcaatctgctcctctttgcaggc

SEQ ID NO: 915 - DNA, 43 bp, Artificial Sequence
  oligo 21-145.29
catttcagattgttgagacaacaagggtacactatttcatgtg

SEQ ID NO: 916 - DNA, 43 bp, Artificial Sequence
  oligo 21-145.30
cacatgaaatagtgtacccttgttgtctcaacaatctgaaatg

SEQ ID NO: 917 - DNA, 40 bp, Artificial Sequence
  oligo 21-145.31
catttcagattgttgagacaacacggtttcaacatctctc

SEQ ID NO: 918 - DNA, 40 bp, Artificial Sequence
  oligo 21-145.32
gagagatgttgaaaccgtgttgtctcaacaatctgaaatg

SEQ ID NO: 919 - DNA, 41 bp, Artificial Sequence
  oligo 21-145.33
catttcagattgttgagacaacatggttacaacgtctctcc

SEQ ID NO: 920 - DNA, 41 bp, Artificial Sequence
  oligo 21-145.34
ggagagacgttgtaaccatgttgtctcaacaatctgaaatg

SEQ ID NO: 921 - DNA, 42 bp, Artificial Sequence
  oligo 21-145.35
gacatcaggggcctactgaacttgtatgaagctgcttatatg

SEQ ID NO: 922 - DNA, 42 bp, Artificial Sequence
  oligo 21-145.36
catataagcagcttcatacaagttcagtaggcccctgatgtc

SEQ ID NO: 923 - DNA, 42 bp, Artificial Sequence
  oligo 21-145.37
gatgtcttaggattattaaacttgtatgaagctgcttatatg

SEQ ID NO: 924 - DNA, 42 bp, Artificial Sequence
  oligo 21-145.38
catataagcagcttcatacaagtttaataatcctaagacatc

SEQ ID NO: 925 - DNA, 42 bp, Artificial Sequence
  oligo 21-145.39
gatgtaagaggcatgctaggcttgtatgaagctgcttatatg

SEQ ID NO: 926 - DNA, 42 bp, Artificial Sequence
  oligo 21-145.40
catataagcagcttcatacaagcctagcatgcctcttacatc

SEQ ID NO: 927 - DNA, 24 bp, Artificial Sequence
  oligo 11-154.4
agccgacaaccttgattggagact

SEQ ID NO: 928 - DNA, 20 bp, Artificial Sequence
  oligo 11-154.3
aatgagcaacggtatacggc

SEQ ID NO: 929 - DNA, 60 bp, Artificial Sequence
  oligo 21-130.3
catttacagagctgatccttattttgaggctcatgaatacaatgatttgcatactgtttc

SEQ ID NO: 930 - DNA, 60 bp, Artificial Sequence
  oligo 21-130.4
aaataaggatcagctctgtaaatgtgatccaacatatcttcaatttctttttcaaaatgg

SEQ ID NO: 931 - DNA, 86 bp, Artificial Sequence
  oligo 21-141.7
gaaaaagaaattgaagatgcattacaacatatttgtaatagttttcatgactgcaatgatatggatggtgatttgcatactgtttc

SEQ ID NO: 932 - DNA, 86 bp, Artificial Sequence
  oligo 21-141.8
gaaacagtatgcaaatcaccatccatatcattgcagtcatgaaaactattacaaatatgttgtaatgcatcttcaatttctttttc

SEQ ID NO: 933 - DNA, 45 bp, Artificial Sequence
  oligo 21-134.9
tctgcagctccacatttgaagtcacctttggctgaacaaattaac

SEQ ID NO: 934 - DNA, 44 bp, Artificial Sequence
  oligo 21-134.10
aggtgacttcaaatgtggagctgcagattgcaaatgagtagtag

SEQ ID NO: 935 - DNA, 63 bp, Artificial Sequence
  oligo 21-141.5
gcaagatacattatgtcaatctacgaagaggaggaatttaagaacaagactttgttaaatttc

SEQ ID NO: 936 - DNA, 63 bp, Artificial Sequence
  oligo 21-141.6
gaaatttaacaaagtcttgttcttaaattcctcctcttcgtagattgacataatgtatcttgc

SEQ ID NO: 937 - DNA, 66 bp, Artificial Sequence
  oligo 21-145.1
gcaagatacattatgtcatcaatctatgacaaggaacaatcgaagaacaagactttgttaaatttc

SEQ ID NO: 938 - DNA, 66 bp, Artificial Sequence
  oligo 21-145.2
gaaatttaacaaagtcttgttcttcgattgttccttgtcatagattgatgacataatgtatcttgc

SEQ ID NO: 939 - DNA, 63 bp, Artificial Sequence
  oligo 21-145.3
gcaagatacattatgtcagtctaccaagatgaagctttccataacaagactttgttaaatttc

SEQ ID NO: 940 - DNA, 63 bp, Artificial Sequence
  oligo 21-145.4
gaaatttaacaaagtcttgttatggaaagcttcatcttggtagactgacataatgtatcttgc

SEQ ID NO: 941 - protein, 548 aa, Nicotiana tabacum
  5-epi-aristolochene synthase
MASAAVANYEEEIVRPVADFSPSLWGDQFLSFSIDNQVAEKYAQEIEALKEQTRSMLLATGRKLADTLNLIDIIERLGISYHFEKEIDEILDQIYNQNSNCNDLCTSALQFRLLRQHGFNISPEIFSKFQDENGKFKESLASDVLGLLNLYEASHVRTHADDILEDALAFSTIHLESAAPHLKSPLREQVTHALEQCLHKGVPRVETRFFISSIYDKEQSKNNVLLRFAKLDFNLLQMLHKQELAQVSRWWKDLDFVTTLPYARDRVVECYFWALGVYFEPQYSQARVMLVKTISMISIVDDTFDAYGTVKELEAYTDAIQRWDINEIDRLPDYMKISYKAILDLYKDYEKELSSAGRSHIVCHAIERMKEVVRNYNVESTWFIEGYTPPVSEYLSNALATTTYYYLATTSYLGMKSATEQDFEWLSKNPKILEASVIICRVIDDTATYEVEKSRGQIATGIECCMRDYGISTKEAMAKFQNMAETAWKDINEGLLRPTPVSTEFLTPILNLARIVEVTYIHNLDGYTHPEEVLKPHIINLLVDSIKI

SEQ ID NO: 942 - protein, 555 aa, Hyoscyamus muticus
  premnaspirodiene synthase
MAPAIVMSNYEEEEIVRPVADFSPSLWGDHFHSFSVDNQVAEKYAQEIETLKEQTSTMLSAACGTTLTEKLNLIDIIERLGIAYHFEKQIEDMLDHIYRADPYFEAHEYNDLNTSSVQFRLLRQHGYNVSPNIFSRFQDANGKFKESLRSDIRGLLNLYEASHVRTHKEDILEEALVFSVGHLESAAPHLKSPLSKQVTHALEQSLHKSIPRVEIRYFISIYEEEEFKNDLLLRFAKLDYNLLQMLHKHELSEVSRWWKDLDFVTTLPYARDRAVECYFWTMGVYAEPQYSQARVMLAKTIAMISIVDDTFDAYGIVKELEVYTDAIQRWDISQIDRLPEYMKISYKALLDLYDDYEKELSKDGRSDVVHYAKERMKEIVGNYFIEGKWFIEGYMPSVSEYLSNALATSTYYLLTTTSYLGMKSATKEHFEWLATNPKILEANATLCRVVDDIATYEVEKGRGQIATGIECYMRDYGVSTEVAMEKFQEMADIAWKDVNEEILRPTPVSSEILTRILNLARIIDVTYKHNQDGYTHPEKVLKPHIIALVVDSIDI

SEQ ID NO: 943 - DNA, 1668 bp, Hyoscyamus muticus
  premnaspirodiene synthase
atggccccagctatagtgatgagtaactacgaagaggaggagattgttcgccctgttgcagatttttctccaagtctttggggtgatcatttccattcattctcagttgacaatcaggttgcggaaaagtatgctcaagagattgaaactttgaaggaacaaacaagtactatgttgtctgctgcttgtggaacaacattgactgagaaattgaatttgatagatattattgagcgccttggaatagcttatcatttcgagaaacaaatagaagatatgttggatcacatttacagagctgatccttattttgaggctcatgaatacaatgatttaaacacttcatccgttcaatttcgactactcagacaacatggttacaacgtctctccaaatatatttagcagattccaagatgcaaatggcaaattcaaggagtctcttagaagcgacatcaggggcctactgaacttatacgaagcttcacatgtaaggactcataaagaggatattttggaagaagcacttgttttttctgttggtcatcttgaatctgcagctccacatttgaagtcacctctgagtaagcaagtgacacatgccctcgaacaatctctccataagagcattccaagagtcgagatacggtacttcatctccatctacgaagaggaggaatttaagaatgatttgttgcttcgatttgctaaattggattacaacttacttcagatgttgcacaagcatgaactcagtgaagtatcaaggtggtggaaagatttggatttcgtgacaacacttccatatgctagggacagagcagttgagtgctacttttggacgatgggggtgtatgctgaacctcaatactcccaggctcgtgtcatgcttgctaagactatagcaatgatttccatagtagatgacacattcgatgcttatggcatcgtaaaagaacttgaagtctacacagatgccatacagaggtgggatattagtcaaattgatcgactcccggaatatatgaaaatcagttataaggctcttttggatctctatgacgattatgaaaaggagttgtcaaaggatggtagatccgatgttgtccactatgcaaaagaaagaatgaaggagattgtgggaaactattttattgaaggaaaatggtttattgagggatatatgccatctgtttccgagtaccttagcaatgcactagctactagcacatattacttgctaactacgacatcctacttgggaatgaaatcagcaaccaaggaacattttgaatggttggctacgaaccctaaaattctggaagctaatgctacattatgccgagttgttgatgacatagccacgtatgaggttgagaagggtaggggtcaaattgcaacaggaattgagtgttatatgagggattacggtgtatccacagaagtagcaatggagaaattccaagaaatggctgacatagcatggaaggatgtaaatgaagaaattcttcgaccaacacctgtctcttcagaaattcttactcgtattctcaacctggctcgaattatagatgtcacttacaagcataatcaagatggatacactcatcctgaaaaagtactaaaacctcacatcatcgccttggtggtggattctattgatatttga

SEQ ID NO: 944 - protein, 548 aa, Artificial Sequence; identical to SEQ ID NO: 850
  CVS variant V287

SEQ ID NO: 945 - DNA, 1647 bp, Artificial Sequence
  CVS variant V287
atgaaagaatgtacgatgttaagaccaactgctgattttcatccatctttgtggaaaaatcattttttgcaaggtgcatcagattttaagactgttgatcatacagctacaaatgaaagacatgaagctttgaaggaagaagttagaagaatgattttagcaaccggaaggaaaccaattcaaaaattgagattgattgatgaagttcaaagattgggtgttgcttaccattttgaaaaagaaattgaagatatgttggatcacatttacagagctgatccttattttgaggctcatgaatacaatgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattctggatgaagctattgcatttactactactcatttgcaatctgcagctccacatttgaagtcacctttggctgaacaaattaaccatgctttgtatagaccattgagaaaaactttgccaagattggaagcaagatacattatgtcatcaatctatgacaaggaacaatcgaagaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttggggacttattttgaatcacaatacgcttttggtagaaaaatcatgactaaattgaactacattttgtccattattgatgatacctacgatgcttacggtactttggaagaatgcacgatgttcagtgaagctgttgctcgttggaacattgaagctgttgatatgttgccagattatatgcgaattatctacagaactttgttggatacattcaacgagatagaagaggatatggctaaacaacggagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaagcaacatggtgtttccaaggaagaggctatcaagatgttcgaggaagatgttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 946 - protein, 548 aa, Artificial Sequence
  CVS variant V288
MKECTMLRPTADFHPSLWKNHFLQGASDFKTVDHTATNERHEALKEEVRRMILATGRKPIQKLRLIDEVQRLGVAYHFEKEIEDMLDHIYRADPYFEAHEYNDLHTVSLHFRLLRQQGIKISCDVFEQFKDDEGRFKSSLINDVQGMLSLYEAAYMAVRGEHILDEAIAFTTTHLQSAAPHLKSPLAEQINHALYRPLRKTLPRLEARYIMSSIYDKEQSKNKTLLNFAKLDFNILLDLHKEELNELTKWWQDLDFTTKLPYARDRLVELYFWDLGTYFESQYAFGRKIMTKLNYILSIIDDTYDAYGTLEECAMFSEAVARWNIEAVDMLPDYMRIIYRTLLDTFNAIEEDMAKQRRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEDVANAWKDINEELMMKPPVVARPLLGTILNLARAIDFIYKEDDGYTHSYLIKEQIASVLGDHVPF

SEQ ID NO: 947 - DNA, 1647 bp, Artificial Sequence
  CVS variant V288
atgaaagaatgtacgatgttaagaccaactgctgattttcatccatctttgtggaaaaatcattttttgcaaggtgcatcagattttaagactgttgatcatacagctacaaatgaaagacatgaagctttgaaggaagaagttagaagaatgattttagcaaccggaaggaaaccaattcaaaaattgagattgattgatgaagttcaaagattgggtgttgcttaccattttgaaaaagaaattgaagatatgttggatcacatttacagagctgatccttattttgaggctcatgaatacaatgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatctgcagctccacatttgaagtcacctttggctgaacaaattaaccatgctttgtatagaccattgagaaaaactttgccaagattggaagcaagatacattatgtcatcaatctatgacaaggaacaatcgaagaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttggggacttattttgaatcacaatacgcttttggtagaaaaatcatgactaaattgaactacattttgtccattattgatgatacctacgatgcttacggtactttggaagaatgcgcgatgttcagtgaagctgttgctcgttggaacattgaagctgttgatatgttgccagattatatgcgaattatctacagaactttgttggatacattcaacgctatagaagaggatatggctaaacaacggagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaagcaacatggtgtttccaaggaagaggctatcaagatgttcgaggaagatgttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 948 - protein, 548 aa, Artificial Sequence; identical to SEQ ID NO: 852
  CVS variant V289

SEQ ID NO: 949 - DNA, 1647 bp, Artificial Sequence
  CVS variant V289
atgtgcatgacaggtgaatcgagaccaactgctgattttcatccatctttgtggaaaaatcattttttgcaaggtgcatcagattttaagactgttgatcatacagctacaaatgaaagacatgaagctttgaaggaagaagttagaagaatgattttagcaaccggaaggaaaccaattcaaaaattgagattgattgatgaagttcaaagattgggtgttgcttaccattttgaaaaagaaattgaagatatgttggatcacatttacagagctgatccttattttgaggctcatgaatacaatgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatctgcagctccacatttgaagtcacctttggctgaacaaattaaccatgctttgtatagaccactgagaaaaactttgccaagattggaagcaagatacattatgtcgtcaatctatgacaaggaacaatcgaagaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttggggacttattttgaatcacaatacgcttttggtagaaaaatcatgactaaattgaactacattttgtccattattgatgatacctacgatgcttacggtactttggaagaatgcacgatgttcagtgaagctgttgctcgttggaacattgaagctgttgatatgttgccagattatatgcgaattatctacagaactttgttggatacattcaacgaaatagaagaggatatggctaaacaacggagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagatgttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 950 - protein, 548 aa, Artificial Sequence; identical to SEQ ID NO: 852
  CVS variant V290

SEQ ID NO: 951 - DNA, 1647 bp, Artificial Sequence
  CVS variant V290
atgtgcatgacaggtgaatcgagaccaactgctgattttcatccatctttgtggaaaaatcattttttgcaaggtgcatcagattttaagactgttgatcatacagctacaaatgaaagacatgaagctttgaaggaagaagttagaagaatgattttagcaaccggaaggaaaccaattcaaaaattgagattgattgatgaagttcaaagattgggtgttgcttaccattttgaaaaagaaattgaagatatgttggatcacatttacagagctgatccttattttgaggctcatgaatacaatgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatctgcagctccacatttgaagtcacctttggctgaacaaattaaccatgctttgtatagaccattgcgtaaaactttgccaagattggaagcaagatacattatgtcatcaatctatgacaaggaacaatcgaagaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttggggacttattttgaatcacaatacgcttttggtagaaaaatcatgactaaattgaactacattttgtccattattgatgatacctacgatgcttacggtactttggaagaatgcacgatgttcagtgaagctgttgctcgttggaacattgaagctgttgatatgttgccagattatatgcgaattatctacagaactttgttggatacattcaacgaaatagaagaggatatggctaaacaacggagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagatgttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 952 - protein, 547 aa, Artificial Sequence
  CVS variant V292
MSSGETFRPTADFHPSLWKNHFLQGASDFKTVDHTATNERHEALKEEVRRMILATGRKPIQKLRLIDEVQRLGVAYHFEKEIEDMLDHIYRADPYFEAHEYNDLHTVSLHFRLLRQQGIKISCDVFEQFKDDEGRFKSSLINDVQGMLSLYEAAYMAVRGEHILDEAIAFTTTHLQSAAPHLKSPLAEQINHALYRPLRKTLPRLEARYIMSVYQDEAFHNKTLLNFAKLDFNILLDLHKEELNELTKWWQDLDFTTKLPYARDRLVELYFWDLGTYFESQYAFGRKIMTKLNYILSIIDDTYDAYGTLEECTMFSEAVARWNIEAVDMLPDYMRIIYRTLLDTFNEIEEDMAKQRRSHCVRYAKEEIQKVIGAYYVQAKWFSEGYVPTIEEYMPIALTSCAYRFVITNSFLGMGDFATKEVFEWISGNPKVVKSASLICRLMDDMQGHEFEQKRGHVASAIECYTKQHGVSKEEAIKMFEEDVANAWKDINEELMMKPPVVARPLLGTILNLARAIDFIYKEDDGYTHSYLIKEQIASVLGDHVPF

SEQ ID NO: 953 - DNA, 1644 bp, Artificial Sequence
  CVS variant V292
atgtcatctggtgaaacttttagaccaactgctgattttcatccatctttgtggaaaaatcattttttgcaaggtgcatcagattttaagactgttgatcatacagctacaaatgaaagacatgaagctttgaaggaagaagttagaagaatgattttagcaaccggaaggaaaccaattcaaaaattgagattgattgatgaagttcaaagattgggtgttgcttaccattttgaaaaagaaattgaagatatgttggatcacatttacagagctgatccttattttgaggctcatgaatacaatgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatctgcagctccgcatttgaagtcacctttggctgaacaaattaaccatgcattgtatagaccattgagaaaaactttgccaagattggaagcaagatacattatgtcagtctaccaagatgaagctttccataacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttggggacttattttgaatcacaatacgcttttggtagaaaaatcatgactaaattgaactacattttgtccattattgatgatacctacgatgcttacggtactttggaagaatgcacgatgttcagtgaagctgttgctcgttggaacattgaagctgttgatatgttgccagattatatgcgaattatctacagaactttgttggatacattcaacgaaatagaagaggatatggctaaacaacggagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctcttatttgtagattgatggacgatatgcaaggacacgaatttgaacaaaaaagaggtcacgttgcatctgcaattgaatgctatactaaacaacatggtgtttccaaggaagaggctatcaagatgttcgaggaagatgttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 954 - protein, 549 aa, Artificial Sequence
  CVS variant V293
MAGEATGRPTADFHPSLWKNHFLQGASDFKTVDHTATNERHEALKEEVRRMILATGRKPIQKLRLIDEVQRLGVAYHFEKEIEDMLDHIYRADPYFEAHEYNDLHTVSLHFRLLRQQGIKISCDVFEQFKDDEGRFKSSLINDVQGMLSLYEAAYMAVRGEHILDEAIAFTTTHLQSAAPHLKSPLAEQINHALYRPLRKTLPRLEARYIMSRIDSTSDDLVNKTLLNFAKLDFNILLDLHKEELNELTKWWQDLDFTTKLPYARDRLVELYFWDLGTYFESQYAFGRKIMTKLNYILSIIDDTYDAYGTLEECTMFSEAVARWNIEAVDMLPDYMRIIYRTLLDTFNEIEEDMAKQRRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEDVANAWKDINEELMMEPPVVARPLLGTILNLARAIDFIYKEDDGYTHSYLIKEQIASVLGDHVPF

SEQ ID NO: 955 - DNA, 1650 bp, Artificial Sequence
  CVS variant V293
atggctggagaggcgacaggaagaccaactgctgattttcatccatctttgtggaaaaatcattttttgcaaggtgcatcagattttaagactgttgatcatacagctacaaatgaaagacatgaagctttgaaggaagaagttagaagaatgattttagcaaccggaaggaaaccaattcaaaaattgagattgattgatgaagttcaaagattgggtgttgcttaccattttgaaaaagaaattgaagatatgttggatcacatttacagagctgatccttattttgaggctcatgaatacaatgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatctgcagctccacatttgaagtcacctttggctgaacaaattaaccatgctttgtatagaccattgagaaaaactttgccaagattggaggcaagatacattatgtcaagaattgattctacttctgatgatttggttaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttggggacttattttgaatcacaatacgcttttggtagaaaaatcatgactaaattgaactacattttgtccattattgatgatacctacgatgcttacggtactttggaagaatgcacgatgttcagtgaagctgttgctcgttggaacattgaagctgttgatatgttgccagattatatgcgaattatctacagaactttgttggatacattcaacgaaatagaagaggatatggctaaacaacggagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagatgttgctaacgcttggaaggatatcaatgaagaattaatgatggaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 956 - protein, 548 aa, Artificial Sequence; identical to SEQ ID NO: 852
  CVS variant V294

SEQ ID NO: 957 - DNA, 1647 bp, Artificial Sequence
  CVS variant V294
atgtgcatgacaggtgaatcgagaccaactgctgattttcatccatctttgtggaaaaatcattttttgcaaggtgcatcagattttaagactgttgatcatacagctacaaatgaaagacatgaagctttgaaggaagaagttagaagaatgattttagcaaccggaaggaaaccaattcaaaaattgagattgattgatgaagttcaaagattgggtgttgcttaccattttgaaaaagaaattgaagatatgttggatcacatttacagagctgatccttattttgaggctcatgaatacaatgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatctgcagctccacatttgaagtcacctttggctgaacaaattaaccatgctttgtatagacccttgagaaaaactttgccaagattggaagcaagatacattatgtcatcaatctatgacaaggaacaatcgaagaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttggggacttattttgaatcacaatacgcttttggtagaaaaatcatgactaaattgaactacattttgtccattattgatgatacctacgatgcttacggtactttggaagaatgcacgatgttcagtgaagctgttgctcgttggaacattgaagctgttgatatgttgccagattatatgcgaattatctacagaactttgttggatacattcaacgaaatagaagaggatatggctaaacaacggagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcagggacacgaatttgaacaaaaaagaggtcacgttgcatctgcaattgaatgctatactaaacaacatggtgtttccaaggaagaggctatcaagatgttcgaggaagatgttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 958 - protein, 548 aa, Artificial Sequence; identical to SEQ ID NO: 850
  CVS variant V295

SEQ ID NO: 959 - DNA, 1647 bp, Artificial Sequence
  CVS variant V295
atgaaagaatgtacgatgttaagaccaactgctgattttcatccatctttgtggaaaaatcattttttgcaaggtgcatcagattttaagactgttgatcatacagctacaaatgaaagacatgaagctttgaaggaagaagttagaagaatgattttagcaaccggaaggaaaccaattcaaaaattgagattgattgatgaagttcaaagattgggtgttgcttaccattttgaaaaagaaattgaagatatgttggatcacatttacagagctgatccttattttgaggctcatgaatacaatgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatctgcagctccacatttgaagtcacctttggctgaacaaattaaccatgctttgtatagacccttgagaaaaactttgccaagattggaagcaagatacattatgtcatcaatctatgacaaggaacaatcgaagaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttggggacttattttgaatcacaatacgcttttggtagaaaaatcatgactaaattgaactacattttgtccattattgatgatacctacgatgcttacggtactttggaagaatgcacgatgttcagtgaagctgttgctcgttggaacattgaagctgttgatatgttgccagattatatgcgaattatctacagaactttgttggatacattcaacgaaatagaagaggatatggctaaacaacggagatctcactgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaagcaacatggtgtttccaaggaagaggctatcaagatgttcgaggaagatgttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 960 - protein, 548 aa, Artificial Sequence; identical to SEQ ID NO: 850
  CVS variant V296

SEQ ID NO: 961 - DNA, 1647 bp, Artificial Sequence; identical to SEQ ID NO: 793
  CVS variant V296

SEQ ID NO: 962 - protein, 549 aa, Artificial Sequence
  CVS variant V297
MSSGETFRPTADFHPSLWKNHFLQGASDFKTVDHTATNERHEALKEEVRRMILATGRKPIQKLRLIDEVQRLGVAYHFEKEIEDMLDHIYRADPYFEAHEYNDLHTVSLHFRLLRQQGYTISCDIFNKFTDERGRFKEALISDVRGMLGLYEAAYMAVRGEHILDEAIAFTTTHLQSAAPHLKSPLAEQINHALYRPLRKTLPRLEARYIMSRIDSTSDDLVNKTLLNFAKLDFNILLDLHKEELNELTKWWQDLDFTTKLPYARDRLVELYFWDLGTYFESQYAFGRKIMTKLNYILSIIDDTYDAYGTLEECTMFSEAVARWNIEAVDMLPDYMRIIYRTLLDTFNEIEEDMAKQRRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEDVANAWKDINEELMMKPPVVARPLLGTILNLARAIDFIYKEDDGYTHSYLIKEQIASVLGDHVPF

SEQ ID NO: 963 - DNA, 1650 bp, Artificial Sequence
  CVS variant V297
atgtcatctggtgaaacttttagaccaactgctgattttcatccatctttgtggaaaaatcattttttgcaaggtgcatcagattttaagactgttgatcatacagctacaaatgaaagacatgaagctttgaaggaagaagttagaagaatgattttagcaaccggaaggaaaccaattcaaaaattgagattgattgatgaagttcaaagattgggtgttgcttaccattttgaaaaagaaattgaagatatgttggatcacatttacagagctgatccttattttgaggctcatgaatacaatgatttgcatactgtttctttgcatttcagattgttgagacaacaagggtacactatttcatgtgatatattcaacaagtttacggatgaacgaggtagattcaaggaagctttgatcagcgatgtaagaggcatgctaggcttgtatgaagctgcttatatggctgttagaggtgaacatattttggatgaagctattgcatttactactactcatttgcaatctgcagctccacatttgaagtcacctttggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttggggacttattttgaatcacaatacgcttttggtagaaaaatcatgactaaattgaactacattttgtccattattgatgatacctacgatgcttacggtactttggaagaatgcacgatgttcagtgaagctgttgctcgttggaacattgaagctgttgatatgttgccagattatatgcgaattatctacagaactttgttggatacattcaacgaaatagaagaggatatggctaaacaacggagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagatgttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 964 - protein, 548 aa, Artificial Sequence; identical to SEQ ID NO: 850
  CVS variant V298

SEQ ID NO: 965 - DNA, 1647 bp, Artificial Sequence
  CVS variant V298
atgaaagaatgtacgatgttaagaccaactgctgattttcatccatctttgtggaaaaatcattttttgcaaggtgcatcagattttaagactgttgatcatacagctacaaatgaaagacatgaagctttgaaggaagaagttagaagaatgattttagcaaccggaaggaaaccaattcaaaaattgagattgattgatgaagttcaaagattgggtgttgcttaccattttgaaaaagaaattgaagatatgttggatcacatttacagagctgatccttattttgaggctcatgaatacaatgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatctgcagctccacatttgaagtcacctttggctgaacaaattaaccatgctttgtatagaccattgagaaaaaccttgccaagattggaagcaagatacattatgtcatcaatctatgacaaggaacaatcgaagaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttggggacttattttgaatcacaatacgcttttggtagaaaaatcatgactaaattgaactacattttgtccattattgatgatacctacgatgcttacggtactttggaagaatgcacgatgttcagtgaagctgttgctcgttggaacattgaagctgttgatatgttgccagattatatgcgaattatctacagaactttgttggatacattcaacgaaatagaagaggatatggctaaacaacggagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggccacgttgcatctgcaattgaatgctatactaagcaacatggtgtttccaaggaagaggctatcaagatgttcgaggaagatgttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 966 - protein, 549 aa, Artificial Sequence
  CVS variant V299
MSSGETFRPTTDFHPSLWKNHFLQGASDFKTVDHTATNERHEALKEEVRRMILATGRKPIQKLRLIDEVQRLGVAYHFEKEIEDMLDHIYRADPYFEAHEYNDLHTVSLHFRLLRQQGIKISCDVFEQFKDDEGRFKSSLINDVQGMLSLYEAAYMAVRGEHILDEAIAFTTTHLQSAAPHLKSPLAEQINHALYRPLRKTLPRLEARYIMSRIDSTSDDLVNKTLLNFAKLDFNILLDLHKEELNELTKWWQDLDFTTKLPYARDRLVELYFWDLGTYFESQYAFGRKIMTKLNYILSIIDDTYDAYGTLEECTMFSEAVARWNIEAVDMLPDYMRIIYRTLLDTFNEIEEDMAKQRRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEDVANAWKDINEELMMKPPVVARPLLGTILNLARAIDFIYKEDDGYTHSYLIKEQIASVLGDHVPF

SEQ ID NO: 967 - DNA, 1650 bp, Artificial Sequence
  CVS variant V299
atgtcctctggtgaaacttttagaccaactactgattttcatccatctttgtggaaaaatcattttttgcaaggtgcatcagattttaagactgttgatcatacagctacaaatgaaagacatgaagctttgaaggaagaagttagaagaatgattttagcaaccggaaggaaaccaattcaaaaattgagattgattgatgaagttcaaagattgggtgtagcttaccattttgaaaaagaaattgaagatatgttggatcacatttacagagctgatccttattttgaggctcatgaatacaatgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatctgcagctccacatttgaagtcacctttggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttggggacttattttgaatcacaatacgcttttggtagaaaaatcatgactaaattgaactacattttgtccattattgatgatacctacgatgcttacggtactttggaagaatgcacgatgttcagtgaagctgttgctcgttggaacattgaagctgttgatatgttgccagattatatgcgaattatctacagaactttgttggatacattcaacgaaatagaagaggatatggctaaacaacggagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagatgttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 968 - protein, 549 aa, Artificial Sequence
  CVS variant V300
TSSGETFRPTADFHPSLWKNHFLQGASDFKTVDHTATNERHEALKEEVRRMILATGRKPIQKLRLIDEVQRLGVAYHFEKEIEDMLDHIYRADPYFEAHEYNDLHTVSLHFRLLRQQGIKISCDVFEQFKDDEGRFKSSLINDVQGMLSLYEAAHMAVRGEHILDEAIAFTTTHLQSAAPHLKSPLAEQINHALYRPLRKTLPRLEARYIMSRIDSTSDDLVNKTLLNFAKLDFNILLDLHKEELNELTKWWQDLDFTTKLPYARDRLVELYFWDLGTYFESQYAFGRKIMTKLNYILSIIDDTYDAYGTLEECTMFSEAVARWNIEAVDMLPDYMRIIYRTLLDTFNEIEEDMAKQRRSHRVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTQQHGVSKEEAIKMFEEDVANAWKDINEELMMKPPVVARPLLGTILNLARAIDFIYKEDDGYTHSYLIKEQIASVLGDHVPF

SEQ ID NO: 969 - DNA, 1650 bp, Artificial Sequence
  CVS variant V300
acgtcatctggtgaaacttttagaccaactgctgattttcatccatctttgtggaaaaatcattttttgcaaggtgcatcagattttaagactgttgatcatacagctacaaatgaaagacatgaagctttgaaggaagaagttagaagaatgattttagcaaccggaaggaaaccaattcaaaaattgagattgattgatgaagttcaaagattgggtgttgcttaccattttgaaaaagaaattgaagatatgttggatcacatttacagagctgatccttattttgaggctcatgaatacaatgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgctcatatggctgttagaggtgaacatattttggatgaagctattgcatttactactactcatttgcaatctgcagctccacatttgaagtcacctttggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttggggacttattttgaatcacaatacgcttttggtagaaaaatcatgactaaattgaactacattttgtccattattgatgatacctacgatgcttacggtactttggaagaatgcacgatgttcagtgaagctgttgctcgttggaacattgaagctgttgatatgttgccagattatatgcgaattatctacagaactttgttggatacattcaacgaaatagaagaggatatggctaaacaacggagatctcatcgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactcaacaacatggtgtttccaaggaagaggctatcaagatgttcgaggaagatgttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 970 - protein, 548 aa, Artificial Sequence; identical to SEQ ID NO: 852
  CVS variant V301

SEQ ID NO: 971 - DNA, 1647 bp, Artificial Sequence
  CVS variant V301
atgtgcatgacaggtgaatcgagaccaactgctgattttcatccatctttgtggaaaaatcattttttgcaaggtgcatcagattttaagactgttgatcatacagctacaaatgaaagacatgaagctttgaaggaagaagttagaagaatgattttagcaaccggaaggaaaccaattcaaaaattgagattgattgatgaagttcaaagattgggtgttgcttaccattttgaaaaagaaattgaagatatgttggatcacatttacagagctgatccttattttgaggctcatgaatacaatgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatctgcagctccacatttgaagtcacctttggctgaacaaattaaccatgctttgtatagaccgttgagaaaaactttgccaagattggaagcaagatacattatgtcatcaatctatgacaaggaacaatcgaagaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttggggacttattttgaatcacaatacgcttttggtagaaaaatcatgactaaattgaactacattttgtccattattgatgatacctacgatgcttacggtactttggaagaatgcacgatgttcagtgaagctgttgctcgttggaacattgaagctgttgatatgttgccagattatatgcgaattatctacagaactttgttggatacattcaacgaaatagaagaggatatggctaaacaacggagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagatgttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 972 - protein, 548 aa, Artificial Sequence; identical to SEQ ID NO: 852
  CVS variant V302

SEQ ID NO: 973 - DNA, 1647 bp, Artificial Sequence
  CVS variant V302
atgtgcatgacaggtgaatcgagaccaactgctgattttcatccatctttgtggaaaaatcattttttgcaaggtgcatcagattttaagactgttgatcatacagctacaaatgaaagacatgaagctttgaaggaagaagttagaagaatgattttagcaaccggaaggaaaccaattcaaaaattgagattgattgatgaagttcaaagattgggtgttgcttaccattttgaaaaagaaattgaagatatgttggatcacatttacagagctgatccttattttgaggctcatgaatacaatgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatctgcagctccacatttgaagtcacctttggctgaacaaattaaccatgctttgtatagaccattgcggaaaactttgccaagattggaagcaagatacattatgtcatcaatctatgacaaggaacaatcgaagaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttggggacttattttgaatcacaatacgcttttggtagaaaaatcatgactaaattgaactacattttgtccattattgatgatacctacgatgcttacggtactttggaagaatgcacgatgttcagtgaagctgttgctcgttggaacattgaagctgttgatatgttgccagattatatgcgaattatctacagaactttgttggatacattcaacgaaatagaagaggatatggctaaacaacggagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagatgttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 974 - protein, 548 aa, Artificial Sequence
  CVS variant V303
MKECTMLRPTADFHPSLWKNHFLQGASDFKTVDHTATNERHEALKEEVRRMILATGRKPIQKLRLIDEVQRLGVAYHFEKEIEDMLDHIYRADPYFEAHEYNDLHTVSLHFRLLRQQGIKISCDVFEQFKDDEGRFKSSLINDVQGMLSLYEAAYMAVRGEHILDEAIAFTTTHLQSAAPHLKSPLAEQINHALYRPLRKQLPRLEARYIMSSIYDKEQSKNKTLLNFAKLDFNILLDLHKEELNELTKWWQDLDFTTKLPYARDRLVELYFWDLGTYFESQYAFGRKIMTKLNYILSIIDDTYDAYGTLEECTMFSEAVARWNIEAVDMLPDYMRIIYRTLLDTFNEIEEDMAKQRRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEDVANAWKDINEELMMKPPVVARPLLGTILNLARAIDFIYKEDDGYTHSYLIKEQIASVLGDHVPF

SEQ ID NO: 975 - DNA, 1647 bp, Artificial Sequence
  CVS variant V303
atgaaagaatgtacgatgttaagaccaactgctgattttcatccatctttgtggaaaaatcattttttgcaaggtgcatcagattttaagactgttgatcatacagctacaaatgaaagacatgaagctttgaaggaagaagttagaagaatgattttagcaaccggaaggaaaccaattcaaaaattgagattgattgatgaagttcaaagattgggtgttgcttaccattttgaaaaagaaattgaagatatgttggatcacatttacagagctgatccttattttgaggctcatgaatacaatgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatctgcagctccacatttgaagtcacctttggctgaacaaattaaccatgctttgtatagaccattgagaaaacaattgccaagattggaagcaagatacattatgtcatcaatctatgacaaggaacaatcgaagaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttggggacttattttgaatcacaatacgcttttggtagaaaaatcatgactaaattgaactacattttgtccattattgatgatacctacgatgcttacggtactttggaagaatgcacgatgttcagtgaagctgttgctcgttggaacattgaagctgttgatatgttgccagattatatgcgaattatctacagaactttgttggatacattcaacgaaatagaagaggatatggctaaacaacggagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaagcaacatggtgtttccaaggaagaggctatcaagatgttcgaggaagatgttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 976 - protein, 549 aa, Artificial Sequence
  CVS variant V304
MSSGETFRPTADFHPSLWKNHFLQGASDFKTVDHTATNERHEALKEEVRRMILATGRKPIQKLRLIDEVQRLGVAYHFEKEIEDMLDHIYRADPYFEAHEYNDLHTVSLHFRLLRQQGIKISCDVFEQFKDDEGRFKSSLINDVQGMLSLYEAAYMAVRGEHILDEAIAFTTTHLQSAAPHLKSPLAEQINHALYRPLRKTLPRLEARYIMSRIDSTSDDLVNKTLLNFAKLDFNILLDLHKEELNELTKWWQDLDFTTKLPYARDRLVELYFWDLGTYFESQYAFGRKIMTKLNYILSIIDDTYDAYGTLEECTMFSEAVARWNIEAVDMLPDYMRIIYRTLLDTFNEIEEDMAKQRRSHCVRYAKEEIQKVIGAYYVQAKWFSEGYVPTIEEYMPIALTSCAYRFVITNSFLGMGDFATKEVFEWISGNPKVVKSASVICRLMDDMLGHEFEQKRGHVASAIECYTKQHGVSKEEAIKMFEEDVANAWKDINEELMMKPPVVARPLLGTILNLARAIDFIYKEDDGYTHSYLIKEQIASVLGDHVPF

SEQ ID NO: 977 - DNA, 1650 bp, Artificial Sequence
  CVS variant V304
atgtcatctggtgaaacttttagaccaactgctgattttcatccatctttgtggaaaaatcattttttgcaaggtgcatcagattttaagactgttgatcatacagctacaaatgaaagacatgaagctttgaaggaagaagttagaagaatgattttagcaaccggaaggaaaccaattcaaaaattgagattgattgatgaagttcaaagattgggtgttgcttaccattttgaaaaagaaattgaagatatgttggatcacatttacagagctgatccttattttgaggctcatgaatacaatgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatctgcagctccacatttgaagtcacctttggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttggggacttattttgaatcacaatacgcttttggtagaaaaatcatgactaaattgaactacattttgtccattattgatgatacctacgatgcttacggtactttggaagaatgtacgatgttcagtgaagctgttgctcgttggaacattgaagctgttgatatgttgccagattatatgcgaattatctacagaactttgttggatacattcaacgaaatagaagaggatatggctaaacaacggagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgctaggacacgaatttgaacaaaaaagaggtcacgttgcatctgcaattgaatgctatactaaacaacatggtgtttccaaggaagaggctatcaagatgttcgaggaagatgttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 978 - protein, 549 aa, Artificial Sequence
  CVS variant V305
MSSGETFRPTADFHPSLWKNHFLQGASDFKTVDHTATNERHEALKEEVRRMILATGRKPIQKLRLIDEVQRLGVAYHFEKEIEDMLDHIYRADPYFEAHEYNDLHTVSLHFRLLRQQGIKISCDVFEQFKDDEGRFKSSLINDVQGMLSLYEAAYMAVRGEHILDDAIAFTTTHLQSAAPHLKSPLAEQINHALYRPLRKTLPRLEARYIMSRIDSTSDDLVNKTLLNFAKLDFNILLDLHKEELNELTKWWQDLDFTTKLPYARDRLVELYFWDLGTYFESQYAFGRKIMTKLNYILSIIDDTYDAYGTLEECTMFSEAVARWNIEAVDMLPDYMRIIYRTLLDTFNEIEEDMAKQRRSHCVRYAKEEIQKVIGAYYVQAKWFSEGYVPTIEEYMPIALTSCAYRFVITNSFLGMGDFATKEVFEWISGNPKVVKSASVICRLMDDMLGHEFEQKRGHVASAIECYTKQHGVSKEEAIKMFEEDVANAWKDINEELMMKPPVVARPLLGTILNLARAIDFIYKEDDGYTHSYLIKEQIASVLGDHVPF

SEQ ID NO: 979 - DNA, 1650 bp, Artificial Sequence
  CVS variant V305
atgtcatctggtgaaacttttagaccaactgctgattttcatccatctttgtggaaaaatcattttttgcaaggtgcatcagattttaagactgttgatcatacagctacaaatgaaagacatgaagctttgaaggaagaagttagaagaatgattttagcaaccggaaggaaaccaattcaaaaattgagattgattgatgaagttcaaagattgggtgttgcttaccattttgaaaaagaaattgaagatatgttggatcacatttacagagctgatccttattttgaggctcatgaatacaatgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgatgctattgcatttactactactcatttgcaatctgcagctccacatctgaagtcacctttggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttggggacttattttgaatcacaatacgcttttggtagaaaaatcatgactaaattgaactacattttgtccattattgatgatacctacgatgcttacggtactttggaagaatgtacgatgttcagtgaagctgttgctcgttggaacattgaagctgttgatatgttgccagattatatgcgaattatctacagaactttgttggatacattcaacgaaatagaagaggatatggctaaacaacggagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgctaggacacgaatttgaacaaaaaagaggtcacgttgcatctgcaattgaatgctatactaaacaacatggtgtttccaaggaagaggctatcaagatgttcgaggaagatgttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 980 - protein, 549 aa, Artificial Sequence
  CVS variant V306
MSSGETFRPTADFHPSLWKNHFLQGASDFKTVDHTATNERHEALKEEVRRMILATGRKPIQKLRLIDEVQRLGVAYHFEKEIEDMLDHIYRADPYFEAHEYNDLHTVSLHFRLLRQQGIKISCDVFEQFKDDEGRFKSSLINDVQGMLSLYEAAYMAVRGEHILDEAIAFTTTHLQSAAPHLKSPLAEQINHALYRPLRKTLPRLEARYITSRIDSTSDDLVNKTLLNFAKLDFNILLDLHKEELNELTKWWQDLDFTTKLPYARDRLVELYFWDLGTYFESQYAFGRKIMTKLNYILSIIDDTYDAYGTLEECTMFSEAVARWNIEAVDMLPDYMRIIYRTLLDTFNEIEEDMAKQRRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEDVANAWKDINEELMMKLPVVARPLLGTILNLARAIDFIYKEDDGYTHSYLIKEQIASVLGDHVPF

SEQ ID NO: 981 - DNA, 1650 bp, Artificial Sequence
  CVS variant V306
atgtcatctggtgaaacttttagaccaactgctgattttcatccatctttgtggaaaaatcattttttgcaaggtgcatcagattttaagactgttgatcatacagctacaaatgaaagacatgaagctttgaaggaagaagttagaagaatgattttagcaaccggaaggaaaccaattcaaaaattgagattgattgatgaagttcaaagattgggtgttgcttaccattttgaaaaagaaattgaagatatgttggatcacatttacagagctgatccttattttgaggctcatgaatacaatgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatctgcagctccacatttgaagtcacctttggctgaacaaattaaccatgctttgtatagaccattgagaaaaactttgccaagattggaagcaagatacattacgtctagaattgattctacttctgatgatttggttaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttggggacttattttgaatcacaatacgcttttggtagaaaaatcatgactaaattgaactacattttgtccattattgatgatacctacgatgcttacggtactttggaagaatgcacgatgttcagtgaagctgttgctcgttggaacattgaagctgttgatatgttgccagattatatgcgaattatctacagaactttgttggatacattcaacgaaatagaagaggatatggctaaacaacggagatctcattgtgtaagatacgctaaagaagaaattcaaaaggttattggtgcttattacgttcaagctaagtggttctctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagatgttgctaacgcttggaaggatatcaatgaagaattaatgatgaaactaccagttgttgctagaccattgttaggtactattttgaatttggctagagctatcgattttatctataaagaagatgacggttacactcattcctatttgattaaggaacaaatagcatctgttttgggtgatcatgttccattttaa

SEQ ID NO: 982 - protein, 549 aa, Artificial Sequence; identical to SEQ ID NO: 744
  CVS variant V307

SEQ ID NO: 983 - DNA, 1650 bp, Artificial Sequence
  CVS variant V307
atgtcatctggtgaaacttttagaccaactgctgattttcatccatctttgtggaaaaatcattttttgcaaggtgcatcagattttaagactgttgatcatacagctacaaatgaaagacatgaagctttgaaggaagaagttagaagaatgattttagcaaccggaaggaaaccaattcaaaaattgagattgattgatgaagttcaaagattgggtgttgcttaccattttgaaaaagaaattgaagatatgttggatcacatttacagagcagatccttattttgaggctcatgaatacaatgatttgcatactgtttctttgcatttcagattgttgagacaacaaggtattaagatttcttgtgatgttttcgaacaatttaaggatgatgaaggtagattcaaaagttctttgattaatgatgttcagggcatgttgtctttgtatgaagctgcttatatggctgttagaggtgaacatattttggatgaagctattgcatttactactactcatttgcaatctgcagctccacatttgaagtcacctttggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttggggacttattttgaatcacaatacgcttttggtagaaaaatcatgactaaattgaactacattttgtccattattgatgatacctacgatgcttacggtactttggaagaatgcacgatgttcagtgaagctgttgctcgttggaacattgaagctgttgatatgttgccagattatatgcgaattatctacagaactttgttggatacattcaacgaaatagaagaggatatggctaaacaacggagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagatgttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcgtctgttttgggtgatcatgttccattttaa

SEQ ID NO: 984 - protein, 549 aa, Artificial Sequence
  CVS variant V308
MSSGETFRPTADFHPSLWKDHFSQGASDFKTVDHTATNERHEALKEEVRRMILATGRKPIQKLRLIDEVQRLGVAYHFEKEIEDMLDHIYRADPYFEAHEYNDLHTVSLHFRLLRQQGIKISCDVFEQFKDDEGRFKSSLINDVQGMLSLYEAAYMAVRGEHILDEAIAFTTTHLESAAPHLKSPLAEQINHALYRPLRKTLPRLEARYIMSRIDSTSDDLVNKTLLNFAKLDFNILLDLHKEELNELTKWWQDLDFTTKLPYARDRLVELYFWDLGTYFESQYAFGRKIMTKLNYILSIIDDTYDAYGTLEECTMFSEAVARWNIEAVDMLPDYMRIIYRTLLDTFNEIEEDMAKQRRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIESYTKQHGVSKEEAIKMFEEDVANAWKDINEELMMKPPVVARPLLGTILNLARAIDFIYKEDDGYTHSYLIKEQIVSVLGDHVPF

SEQ ID NO: 985 - DNA, 1650 bp, Artificial Sequence
  CVS variant V308
atgtcatctggtgaaacttttagaccaactgctgattttcatccatctttgtggaaagaccatttttcgcaaggtgcatcagattttaagactgttgatcatacagctacaaatgaaagacatgaagctttgaaggaagaagttagaagaatgattttagcaaccggaaggaaaccaattcaaaaattgagattgattgatgaggttcaaagattgggtgttgcttaccattttgaaaaagaaattgaagatatgttggatcacatttacagagctgatccttattttgaggctcatgaatacaatgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttggaatctgcagctccacatttgaagtcacctttggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttggggacttattttgaatcacaatacgcttttggtagaaaaatcatgactaaattgaactacattttgtccattattgatgatacctacgatgcttacggtactttggaagaatgcacgatgttcagtgaagctgttgctcgttggaacattgaagctgttgatatgttgccagattatatgcgaattatctacagaactttgttggatacattcaacgaaatagaagaggatatggctaaacaacggagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaaagctatactaaacaacatggtgtttccaaggaagaggctatcaagatgttcgaggaagatgttgctaacgcttggaaggatatcaatgaagaattaatgatgaaaccaccagttgttgctagaccattgttaggtactattttgaatttggctagagctatcgattttatctataaagaagatgacgggtacactcattcttatttgattaaggaacaaatagtatctgttttgggtgatcatgttccattttaa

SEQ ID NO: 986 - protein, 548 aa, Artificial Sequence
  CVS variant V309
MCMTGESRPTADFHPSLWKNHFLQGASDFKTVDHTATNERHEALKEEVRRMILATGRKPIQKLRLIDEVQRLGVAYHFEKEIEDMLDHIYRADPYFEAHEYNDLHTVSLHFRLLRQQGIKISCDVFEQFKDDEGRFKSSLINDVQGMLSLYEAAYMAVRGEHILDEAIAFTTTHLQSAAPHLKSPLAEQINHALYRPLRKTLPRLEARYIMSSIYDKEQSKNKTLLNFAKLDFNILLDLHKEELNELTKWWQDLDFTTKLPYARDRLVELYFWDLGTYFESQYAFGRKIMTKLNYILSIIDDTYDAYGTLEECTMFSEAVARWNIEAVDMLPDYMRIIYRTLLDTFNAIEEDMAKQRRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEDVANAWKDINEELMMKPPVVARPLLGTILNLARAIDFIYKEDDGYTHSYLIKEQIASVLGDHVPF

SEQ ID NO: 987 - DNA, 1647 bp, Artificial Sequence
  CVS variant V309
atgtgcatgacaggtgaatcgagaccaactgctgattttcatccatctttgtggaaaaatcattttttgcaaggtgcatcagattttaagactgttgatcatacagctacaaatgaaagacatgaagctttgaaggaagaagttagaagaatgattttagcaaccggaaggaaaccaattcaaaaattgagattgattgatgaagttcaaagattgggtgttgcttaccattttgaaaaagaaattgaagatatgttggatcacatttacagagctgatccttattttgaggctcatgaatacaatgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatctgcagctccacatttgaagtcacctttggctgaacaaattaaccatgctttgtatagaccattgagaaaaactttgccaagattggaagcaagatacattatgtcatcaatctatgacaaggaacaatcgaagaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttggggacttattttgaatcacaatacgcttttggtagaaaaatcatgactaaattgaactacattttgtccattattgatgatacctacgatgcttacggtactttggaagaatgcacgatgttcagtgaagctgttgctcgttggaacattgaagctgttgatatgttgccagattatatgcgaattatctacagaactttgttggatacattcaacgctatagaagaggatatggctaaacaacggagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagatgttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 988 - protein, 548 aa, Artificial Sequence
  CVS variant V310
MCMTGESRPTADFHPSLWKNHFLQGASDFKTVDHTATNERHEALKEEVRRMILATGRKPIQKLRLIDEVQRLGVAYHFEKEIEDMLDHIYRADPYFEAHEYNDLHTVSLHFRLLRQQGIKISCDVFEQFKDDEGRFKSSLINDVQGMLSLYEAAYMAVRGEHILDEAIAFTTTHLQSAAPHLKSPLAEQINHALYRPLRKTLPRLEARYIMSSIYDKEQSKNKTLLNFAKLDFNILLDLHKEELNELTKWWQDLDFTTKLPYARDRLVELYFWDLGTYFESQYAFGRKIMTKLNYILSIIDDTYDAYGTLEECTMFSEAVARWNIEAVDMLPDYMRIIYRTLLDTFNSIEEDMAKQRRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEDVANAWKDINEELMMKPPVVARPLLGTILNLARAIDFIYKEDDGYTHSYLIKEQIASVLGDHVPF

SEQ ID NO: 989 - DNA, 1647 bp, Artificial Sequence
  CVS variant V310
atgtgcatgacaggtgaatcgagaccaactgctgattttcatccatctttgtggaaaaatcattttttgcaaggtgcatcagattttaagactgttgatcatacagctacaaatgaaagacatgaagctttgaaggaagaagttagaagaatgattttagcaaccggaaggaaaccaattcaaaaattgagattgattgatgaagttcaaagattgggtgttgcttaccattttgaaaaagaaattgaagatatgttggatcacatttacagagctgatccttattttgaggctcatgaatacaatgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatctgcagctccacatttgaagtcacctttggctgaacaaattaaccatgctttgtatagaccattgagaaaaactttgccaagattggaagcaagatacattatgtcatcaatctatgacaaggaacaatcgaagaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttggggacttattttgaatcacaatacgcttttggtagaaaaatcatgactaaattgaactacattttgtccattattgatgatacctacgatgcttacggtactttggaagaatgcacgatgttcagtgaagctgttgctcgttggaacattgaagctgttgatatgttgccagattatatgcgaattatctacagaactttgttggatacattcaactcaatagaagaggatatggctaaacaacggagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagatgttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 990 - protein, 550 aa, Artificial Sequence
  CVS variant V311
MSSGETFRPTADFHPSLWRNHFLQGASDFKTVDHTATNERHEALKEEVRRMITDAEDQPIQKLRLIDEVQRLGVAYHFEKEIEDAIQQLCNSFHDCNDMDGDLHTVSLHFRLLRQQGIKISCDVFEQFKDDEGRFKSSLINDVQGMLSLYEAAYMAVRGEHILDEAIAFTTTHLQSLVAQDHVTPRLAEQINHALYRPLRKTLPRLEARYIMSRIDSTSDDLVNKTLLNFAKLDFNILLDLHKEELNELTKWWQDLDFTTKLPYARDRLVELYFWDLGTYFEPQYAFGRKIMTKLNYILSIIDDTYDAYGTLEELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 991 - DNA, 1653 bp, Artificial Sequence
  CVS variant V311
atgtcatctggtgaaacttttagaccaactgctgattttcatccatctttgtggagaaatcattttttgcaaggtgcatcagattttaagactgttgatcatacagctacaaatgaaagacatgaagctttgaaggaagaagttagaagaatgattactgatgcagaagatcaaccaattcaaaaattgagattgattgatgaagttcaaagattgggtgttgcttaccattttgaaaaagaaattgaagatgctattcaacaattgtgtaatagttttcatgactgcaatgatatggatggtgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttgggtacttattttgaaccacaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 992 - protein, 550 aa, Artificial Sequence
  CVS variant V312
MSSGETFRPTADFHPSLWRNHFLQGASDFKTVDHTATNERHEALKEEVRRMITDAEDQPIQKLRLIDEVQRLGVAYHFEKEVEDAIQQLCNSFHDCNDMDGDLHTVSLHFRLLRQQGIKISCDVFEQFKDDEGRFKSSLINDVQGMLSLYEAAYMAVRGEHILDEAIAFTTTHLQSLVAQDHVTPRLAEQINHALYRPLRKTLPRLEARYIMSRIDSTSDDLVNKTLLNFAKLDFNILLDLHKEELNELTKWWQDLDFTTKLPYARDRLVELYFWDLGTYFEPQYAFGRKIMTKLNYILSIIDDTYDAYGTLEELSLFTEAVARWNIEAVDMLPDYMKLIYRTLLDTFNEIEEDMAKQGRSHCVRYAKEEIQKVIGAYYVQAKWFSEGYVPTIEEYMPIASTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 993 - DNA, 1653 bp, Artificial Sequence
  CVS variant V312
atgtcatctggtgaaacttttagaccaactgctgattttcatccatctttgtggagaaatcattttttgcaaggtgcatcagattttaagactgttgatcatacagctacaaatgaaagacatgaagctttgaaggaagaagttagaagaatgattactgatgcagaagatcaaccaattcaaaaattgagattgattgatgaagttcaaagattgggtgttgcttaccattttgaaaaagaagttgaagatgctattcaacaattgtgtaatagttttcatgactgcaatgatatggatggtgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttgggtacttattttgaaccacaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgcttcgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 994 - protein, 556 aa, Artificial Sequence
  CVS variant V313
MSTQVSASSLAQIPQPKNRPVANFHPNIWGDQFITYTPEDKVTRACKEEQIEALKEEIRRMILATGRKPIQKLRLIDEVQRLGVAYHFEKEIEDALQHICNSFHDCNDMDGDLYTVSLHFRLLRQQGYTISCDIFNKFTDERGRFKEALISDVRGMLGLYEAAYMAVRGEHILDEAIAFTTTHLQSAAPHLKSPLAEQINHALYRPLRKTLPRLEARYIMSVYQDEAFHNKTLLNFAKLDFNILLDLHKEELNELTKWWQDLDFTTKLPYARDRLVELYFWDLGTYFESQYAFGRKIMTKLNYILSIIDDTYDAYGTLEECTMFSEAVARWNIEAVDMLPDYMRIIYRTLLDTFNEIEEDMAKQRRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEDVANAWKDINEELMMKPPVVARPLLGTILNLARAIDFIYKEDDGYTHSYLIKEQIASVLGDHVPF

SEQ ID NO: 995 - DNA, 1671 bp, Artificial Sequence
  CVS variant V313
atgtctactcaagtctcagcatcttctctagcccagattccccaacccaaaaatcgtcctgtggcaaactttcaccccaacatttggggtgaccaatttatcacctacactcctgaagacaaggttactcgtgcctgcaaagaggagcagattgaagctttgaaggaagaaattagaagaatgattttagcaaccggaaggaaaccaattcaaaaattgagattgattgatgaagttcaaagattgggtgttgcttaccattttgaaaaagaaattgaagatgcattacaacatatttgtaatagttttcatgactgcaatgatatggatggtgatttgtatactgtttctttgcatttcagattgttgagacaacaagggtacactatttcatgtgatatattcaacaagtttacggatgaacgaggtagattcaaggaagctttgatcagcgatgtaagaggcatgctaggcttgtatgaagctgcttatatggctgttagaggtgaacatattttggatgaagctattgcatttactactactcatttgcaatctgcagctccacatttgaagtcacctttggctgaacaaattaaccatgctttgtatagaccattgagaaaaactttgccaagattggaagcaagatacattatgtcagtctaccaagatgaagctttccataacaagactttgttaaatttcgctaagttggatttcaatattttgttggatttgcataaagaagaattgaacgaattgactaaatggtggcaagatttggattttactactaaattgccatatgctagagatagattggttgaactgtacttttgggatttggggacttattttgaatcacaatacgcttttggtagaaaaatcatgactaaattgaactacattttgtccattattgatgatacctacgatgcttacggtactttggaagaatgcacgatgttcagtgaagctgttgctcgttggaacattgaagctgttgatatgttgccagattatatgcgaattatctacagaactttgttggatacattcaacgaaatagaagaggatatggctaaacaacggagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagatgttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatcgcatctgttttgggtgatcatgttccattttaa

SEQ ID NO: 996 - protein, 556 aa, Artificial Sequence
  CVS variant V314
MSTQVSASSLAQIPQPKNRPVANFHPNIWGDQFITYTPEDKVTRACKEEQIEALKEEVRRMILATGRKPIQKLRLIDEVQRLGVAYHFEKEIEDALQHICNSFHDCNDMDGDLHTVSLHFRLLRQQGIKISCDVFEQFKDDEGRFKSSLINDVQGMLSLYEAAYMAVRGEHILDEAIAFTTTHLQSAAPHLKSPLAEQINHALYRPLRKTLPRLEARYIMSVYQDEAFHNKTLLNFAKLDFNILLDLHKEELNELTKWWQDLDFTTKLPYARDRLVELYFWDLGTYFESQYAFGRKIMTKLNYILSIIDDTYDAYGTLEECTMFSEAVARWNIEAVDMLPDYMRIIYRTLLDTFNEIEEDMAKQRRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEDVANAWKDINEELMMKPPVVARPLLGTILNLARAIDFIYKEDDGYTHSYLIKEQIASVLGDHVPF

SEQ ID NO: 997 - DNA, 1671 bp, Artificial Sequence
  CVS variant V314
atgtctactcaagtctcagcatcttctctagcccagattccccaacccaaaaatcgtcctgtggcaaactttcaccccaacatttggggtgaccaatttatcacctacactcctgaagacaaggttactcgtgcctgcaaagaggagcagattgaagctttgaaggaagaagttagaagaatgattttagcaaccggaaggaaaccaattcaaaaattgagattgattgatgaagttcaaagattgggtgttgcttaccattttgaaaaagaaattgaagatgcattacaacatatttgtaatagttttcatgactgcaatgatatggatggtgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatctgcagctccacatttgaagtcacctttggctgaacaaattaaccatgctttgtatagaccattgagaaaaactttgccaagattggaagcaagatacattatgtcagtctaccaagatgaagctttccataacaagactttgttaaatttcgctaagttggatttcaatattttgttggatttgcataaagaagaattgaacgaattgactaaatggtggcaagatttggattttactactaaattgccatatgctagagatagattggttgaactgtacttttgggatttggggacttattttgaatcacaatacgcttttggtagaaaaatcatgactaaattgaactacattttgtccattattgatgatacctacgatgcttacggtactttggaagaatgcacgatgttcagtgaagctgttgctcgttggaacattgaagctgttgatatgttgccagattatatgcgaattatctacagaactttgttggatacattcaacgaaatagaagaggatatggctaaacaacggagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagatgttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatcgcatctgttttgggtgatcatgttccattttaa

SEQ ID NO: 998 - protein, 557 aa, Artificial Sequence; identical to SEQ ID NO: 887
  CVS variant V315

SEQ ID NO: 999 - DNA, 1674 bp, Artificial Sequence
  CVS variant V315
atgtctactcaagtctcagcatcttctctagcccagattccccaacccaaaaatcgtcctgtggcaaactttcaccccaacatttggggtgaccaatttatcacctacactcctgaagacaaggttactcgtgcctgcaaagaggagcagattgaagctttgaaggaagaagttagaagaatgattttagcaaccggaaggaaaccaattcaaaaattgagattgattgatgaagttcaaagattgggtgttgcttaccattttgaaaaagaaattgaagatatgttggatcacatttacagagctgatccttattttgaggctcatgaatacaatgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatctgcagctccacatttgaagtcacctttggctgaacaaattaaccatgctttgtatagaccattgagaaaaactttgccaagattggaagcaagatacattatgtcagtctaccaagatgaagctttccataacaagactttgttaaatttcgctaagttggatttcaatattttgttggatttgcataaagaagaattgaacgaattgactaaatggtggcaagatttggattttactactaaattgccatatgctagagatagattggttgaactgtacttttgggatttggggacttattttgaatcacaatacgcttttggtagaaaaatcatgactaaattgaactacattttgtccattattgatgatacctacgatgcttacggtactttggaagaatgcacgatgttcagtgaagctgttgctcgttggaacattgaagctgttgatatgttgccagattatatgcgaattatctacagaactttgttggatacattcaacgaaatagaagaggatatggctaaacaacggagatctcattgtgtaagatacgctaaagaagaaattcaaaaggttattggtgcttattacgttcaagctaagtggttttctgaaggttatgtccctactattgaagaatacatgccaattgctctgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagatgttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatcgcatctgttttgggtgatcatgttccattttaa

SEQ ID NO: 1000 - protein, 32 aa, Artificial Sequence
  CVS115-146
GIKISCDVFEKFKDDEGRFKSSLINDVQGMLS

SEQ ID NO: 1001 - protein, 32 aa, Artificial Sequence
  VITIS128-159
GYTISCDIFNKFTDERGRFKEALISDVRGMLG

SEQ ID NO: 1002 - DNA, 68 bp, Artificial Sequence
  primer 21-141.3
gctattcaacaattgtgtaatagttttcatgactgcaatgatatggatggtgatttgcatactgtttc

SEQ ID NO: 1003 - DNA, 68 bp, Artificial Sequence
  primer 21-141.4
gaaacagtatgcaaatcaccatccatatcattgcagtcatgaaaactattacacaattgttgaatagc

SEQ ID NO: 1004 - DNA, 43 bp, Artificial Sequence; identical to SEQ ID NO: 915
  primer 21-145.29

SEQ ID NO: 1005 - DNA, 43 bp, Artificial Sequence; identical to SEQ ID NO: 916
  primer 21-145.30

SEQ ID NO: 1006 - DNA, 42 bp, Artificial Sequence; identical to SEQ ID NO: 925
  primer 21-145.39

SEQ ID NO: 1007 - DNA, 42 bp, Artificial Sequence; identical to SEQ ID NO: 926
  primer 21-145.40

The invention claimed is:

1. A nucleic acid molecule encoding a modified valencene synthase polypeptide, wherein:

the modified valencene synthase comprises an amino acid replacement or amino acid replacements at one or more positions corresponding to positions selected from among 60, 97, 209, 212, 214, 221, 238, 292, 333, 345, 369, 405, 429, 473 and/or 536 in the valencene synthase polypeptide whose sequence is set forth in SEQ ID NO:2;

the modified valencene synthase polypeptide comprises a sequence of amino acids that has less than 100% or has 100% identity to the modified valencene synthase polypeptide set forth in SEQ ID NO:3;

the modified valencene synthase polypeptide comprises a sequence of amino acids that has less than 95% identity to the valencene synthase polypeptide set forth in SEQ ID NO:2; and the modified valencene synthase polypeptide comprises a sequence of amino acids that has greater than 80% sequence identity to the valencene synthase set forth in SEQ ID NO:2; and the modified valencene synthase catalyzes the formation of valencene from farnesyl diphosphate (FPP) in a host cell in an amount that is greater than the amount of valencene produced from FPP when catalyzed by the valencene synthase set forth in SEQ ID NO:2 in the same host cell and under the same conditions, wherein the host cell is a cell that produces FPP.

2. A nucleic acid molecule encoding a modified valencene synthase polypeptide, wherein:

the modified valencene synthase comprises an amino acid replacement(s) at a position corresponding to positions selected from among 60, 97, 209, 212, 214, 221, 238, 292, 333, 345, 369, 405, 429, 473 and/or 536, with numbering relative to the valencene synthase polypeptide set forth in SEQ ID NO:2;

the modified valencene synthase polypeptide comprises amino acid replacement(s) compared to the valencene synthase set forth in SEQ ID NO:2; whereby the modified valencene synthase polypeptide comprises a sequence of amino acids that has less than 100% identity and more than 80% identity to the valencene synthase polypeptide set forth in SEQ ID NO:2; and the modified valencene synthase catalyzes the formation of valencene from farnesyl diphosphate (FPP) in a host cell in an amount that is greater than the amount of valencene produced from FPP when catalyzed by the valencene synthase set forth in SEQ ID NO:2 in the same host cell and under the same conditions, wherein the host cell is a cell that produces FPP.

3. The nucleic acid molecule of claim 1, wherein the host cell is a yeast cell.

4. The nucleic acid molecule of claim 1, wherein the encoded modified valencene synthase polypeptide comprises amino acid replacements selected from among V60I, V60G, N97D, F209I, F209H, F209E, F209L, F209T, M212R, M212D, M212N, M212S, M212A, M212Y, M212K, M212F, M212H, M212Q, N214D, N214E, N214S, N214L, N214Y, N214V, N214P, N214H, N214C, N214A, N214T, N214R, Y221C, Y221V, Y221Q, Y221F, Y221S, Y221N, Y221T, Y221P, Y221L, Y221K, Y221W, Y221E, Y221V, E238D, Q292K, E333D, A345V, A345T, N369I, T405R, N429S, N429G, S473Y, and/or D536E by CVS numbering with reference to positions set forth in SEQ ID NO:2.

5. The nucleic acid molecule of claim 1, wherein the encoded modified valencene synthase comprises amino acid replacements at positions corresponding to positions 60, 209, 238 and 292 by CVS numbering with numbering relative to positions in the valencene synthase polypeptide set forth in SEQ ID NO:2.

6. The nucleic acid molecule of claim 5, wherein the encoded modified valencene synthase polypeptide comprises:

a replacement at position V60 that is V60I or V60G;

a replacement at position F209 that is F209I, F209H, F209E, F209L or F209T;

a replacement at position E238 that is E238D; and a replacement at position Q292, that is Q292K, each by CVS numbering relative to positions set forth in SEQ ID NO:2.

7. The nucleic acid molecule of claim 5, wherein the encoded modified valencene synthase further comprises amino acid replacements at positions corresponding to positions 125, 173, and 252 with numbering relative to the valencene synthase polypeptide set forth in SEQ ID NO:2.

8. The nucleic acid molecule of claim 7, wherein the encoded modified valencene synthase polypeptide comprises:

a replacement at position V60 that is V60I or V60G;

a replacement at position K125 that is K125A or K125Q;

a replacement at position K173 that is K173E, K173Q or K173A;

a replacement at position F209 that is F209I, F209H, F209E, F209L or F209T;

a replacement at position E238 that is E238D;

a replacement at position K252 that is K252Q; and a replacement at position Q292, that is Q292K, each by CVS numbering relative to positions set forth in SEQ ID NO:2.

9. The nucleic acid molecule of claim 1, wherein the modified valencene synthase comprises amino acid replacements selected from among replacements corresponding to:

K24A/Q38A/K58A/V60I/K88A/Y93H/N97D/R98K/K125A/K173A/K184R/F209I/M212R/N214D/H219D/Y221V/E238D/K252A/Q292K/Q321A/E333D/A345T/N369I/S377Y/T405R/N429G/A436S/T501P/D536E;

K24Q/Q38N/K58Q/V60I/K88Q/Y93H/N97D/R98K/K125Q/K173Q/K184R/F209I/M212R/N214D/H219D/Y221V/E238D/K252Q/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/Q292K/V320S/Q321A/E326K/E333D/A345T/N369I/S377Y/T405R/N429G/A436S/T501P/D536E;

K24A/Q38A/R50G/K58A/V60I/K88A/Y93H/N97D/R98K/K125A/K173A/K184R/F209I/M212R/N214D/H219D/Y221V/E238D/K252A/Q292K/V320G/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/Q292K/L315M/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/Q292K/V320G/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/Q292K/Q321A/E333D/A345T/G357R/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/Q292K/Q321A/E333D/A345T/N369I/E367G/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/Q292K/Q321A/E333D/A345T/N369I/Q370D/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/Q292K/I299Y/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/Q292K/Q321A/E333D/A345T/H360L/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/Q292K/T317S/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/Q292K/V320D/Q321A/E333D/A345T/N369I/S377Y/T405R/N429G/A436S/T501P/D536E;

K24A/Q38V/K58A/V60I/K88A/Y93H/N97D/R98K/K125A/K173A/K184R/F209I/M212R/N214D/H219D/Y221V/E238D/K252A/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/Q292K/Q321A/E333D/A345T/N369I/S377Y/T405R/T409G/N429G/A436S/E495G/T501P/D536E;

K24A/Q38A/K58A/V60I/K88A/Y93H/N97D/R98K/K125A/K173A/K184R/F209I/M212R/N214D/H219D/Y221V/E238D/K252A/P281S/Q292K/Q321A/E333D/L337I/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/Q292K/Q321A/E333D/A345T/N369I/A375D/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/Q292K/Q321A/E333D/K336R/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/Q292K/E311P/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/Q292K/Q321A/E333D/A345T/N369I/Q370H/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/Q292K/Q321A/E333D/L343V/A345T/H360A/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/Q282S/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/Q292K/Q321A/E333D/A345T/N369I/K371G/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/Q292K/Q321A/E333D/A345T/N347L/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/Q292K/E311T/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/

H219D/Y221V/E238D/K252A/Q282L/Q292K/
Q321A/E333D/A345T/N369I/S377Y/T405R/N429G/
A436S/T501P/D536E;
K24A/Q38A/K58A/V60I/K88A/Y93H/N97D/R98K/
K125A/K173A/K184R/F209I/M212R/N214D/
H219D/Y221V/E238D/K252A/Q292K/S314T/
Q321A/E333D/A345T/N369I/S377Y/T405R/N429G/
A436S/T501P/D536E;
K24A/Q38A/K58A/V60I/K88A/Y93H/N97D/R98K/
K125A/K173A/K184R/F209I/M212R/N214D/
H219D/Y221V/E238D/K252A/Q292K/Q321A/
E333D/A345T/N369I/Q370G/S377Y/T405R/N429G/
A436S/T501P/D536E;
K24A/Q38A/K58A/V60I/K88A/Y93H/N97D/R98K/
K125A/K173A/K184R/F209I/M212R/N214D/
H219D/Y221V/E238D/K252A/Q292K/L310H/
Q321A/E333D/A345T/V362A/N369I/S377Y/T405R/
N429G/A436S/T501P/D536E;
K24A/Q38A/K58A/V60I/F78L/K88A/Y93H/N97D/
R98K/K125A/K173A/K184R/F209I/M212R/N214D/
H219D/Y221V/E238D/K252A/Q292K/L313C/
Q321A/E333D/A345T/N369I/S377Y/T405R/N429G/
A436S/T501P/D536E;
K24Q/Q38N/K58Q/V60I/K88Q/Y93H/N97D/R98K/
K125Q/K173Q/K184R/F209I/M212R/N214D/
H219D/Y221V/E238D/K252Q/P281S/Q292K/I299Y/
L310H/E311P/Q321A/E333D/A345T/N369I/S377Y/
T405R/N429G/A436S/T501P/D536E;
K24Q/Q38N/K58Q/V60I/K88Q/Y93H/N97D/R98K/
K125Q/K173Q/K184R/F209I/M212R/N214D/
H219D/Y221V/E238D/K252Q/P281S/Q282L/Q292K/
L310H/Q321A/E333D/A345T/N369I/S377Y/T405R/
N429G/A436S/T501P/D536E;
K24Q/Q38N/K58Q/V60I/K88Q/Y93H/N97D/R98K/
K125Q/K173Q/K184R/F209I/M212R/N214D/
H219D/Y221V/E238D/K252Q/P281S/Q282L/Q292K/
I299Y/E311P/Q321A/E333D/A345T/N369I/S377Y/
T405R/N429G/A436S/T501P/D536E;
K24Q/Q38N/K58Q/V60I/K88Q/Y93H/N97D/R98K/
K125Q/K173Q/K184R/F209I/M212R/N214D/
H219D/Y221V/E238D/K252Q/P281S/Q292K/L313C/
S314T/L315M/T317S/Q321A/E333D/A345T/N369I/
S377Y/T405R/N429G/A436S/T501P/D536E;
K24Q/Q38N/K58Q/V60I/K88Q/Y93H/N97D/R98K/
K125Q/K173Q/K184R/F209I/M212R/N214D/
H219D/Y221V/E238D/K252Q/P281S/Q292K/
Q321A/E333D/K336R/A345T/N347L/G357R/N369I/
S377Y/T405R/N429G/A436S/T501P/D536E;
K24Q/Q38N/K58Q/V60I/K88Q/Y93H/N97D/R98K/
K125Q/K173Q/K184R/F209I/M212R/N214D/
H219D/Y221V/E238D/K252Q/Q292K/L310H/
E311T/L313C/S314T/L315M/T317S/V320G/Q321A/
E333D/A345T/N369I/S377Y/T405R/N429G/A436S/
T501P/D536E;
K24Q/Q38N/K58Q/V60I/K88Q/Y93H/N97D/R98K/
K125Q/K173Q/K184R/F209I/M212R/N214D/
H219D/Y221V/E238D/K252Q/P281S/Q292K/T317S/
Q321A/E333D/K336R/L337I/A345T/N347L/G357R/
N369I/S377Y/T405R/N429G/A436S/T501P/D536E;
K24Q/Q38N/K58Q/V60I/K88Q/Y93H/N97D/R98K/
K125Q/K173Q/K184R/F209I/M212R/N214D/
H219D/Y221V/E238D/K252Q/Q292K/T317S/
Q321A/E333D/K336R/L337I/A345T/G357R/N369I/
S377Y/T405R/N429G/A436S/T501P/D536E;
K24Q/Q38N/K58Q/V60I/K88Q/Y93H/N97D/R98K/
K125Q/K173Q/K184R/F209I/M212R/N214D/
H219D/Y221V/E238D/K252Q/P281S/Q292K/T317S/
Q321A/E333D/K336R/A345T/N347L/G357R/N369I/
S377Y/T405R/N429G/A436S/T501P/D536E;
K24Q/Q38N/K58Q/V60I/K88Q/Y93H/N97D/R98K/
K125Q/K173Q/K184R/F209I/M212R/N214D/
H219D/Y221V/E238D/K252Q/P281S/Q292K/T317S/
Q321A/E333D/A345T/G357R/N369I/S377Y/T405R/
N429G/A436S/T501P/D536E;
K24Q/Q38N/K58Q/V60I/K88Q/Y93H/N97D/R98K/
K125Q/K173Q/K184R/F209I/M212R/N214D/
H219D/Y221V/E238D/K252Q/P281S/Q292K/L310H/
E311T/L313C/T317S/V320G/Q321A/E333D/A345T/
N369I/S377Y/T405R/N429G/A436S/T501P/D536E;
K24Q/Q38N/K58Q/V60I/K88Q/Y93H/N97D/R98K/
K125Q/K173Q/K184R/F209I/M212R/N214D/
H219D/Y221V/E238D/K252Q/P281S/Q292K/L313C/
S314T/L315M/T317S/Q321A/E333D/K336R/A345T/
N347LG357R/N369I/S377Y/T405R/N429G/A436S/
T501P/D536E;
K24Q/Q38N/K58Q/V60I/K88Q/Y93H/N97D/R98K/
K125Q/K173Q/K184R/F209I/M212R/N214D/
H219D/Y221V/E238D/K252Q/Q292K/Q321A/
E333D/A345T/N369I/Q370D/A375D/S377Y/T405R/
T409G/N429G/A436S/E495G/T501P/D536E;
K24Q/Q38N/K58Q/V60I/K88Q/Y93H/N97D/R98K/
K125Q/K173Q/K184R/F209I/M212R/N214D/
H219D/Y221V/E238D/K252Q/P281S/Q292K/L313C/
S314T/L315M/T317S/Q321A/E333D/K336R/L337I/
A345T/N347L/G357R/N369I/S377Y/T405R/N429G/
A436S/T501P/D536E;
K24Q/Q38N/K58Q/V60I/K88Q/Y93H/N97D/R98K/
K125Q/K173Q/K184R/F209I/M212R/N214D/
H219D/Y221V/E238D/K252Q/P281S/Q292K/L313C/
S314T/L315M/T317S/Q321A/L333D/K336R/L337I/
A345T/G357R/N369I/S377Y/I405R/N429G/A436S/
T501P/D536E;
S2R/S3D/G4K/E5G/F7C/K24Q/Q38N/K58Q/V60I/
K88Q/Y93H/N97D/R98K/K125Q/K173Q/K184R/
F209I/M212R/N214D/H219D/Y221V/E238D/K252Q/
Q292K/Q321A/E333D/A345T/N369I/S377Y/T405R/
N429G/A436S/T501P/D536E;
S2E/S3G/G4N/E5S/T6V/F7Q/K24Q/Q38N/K58Q/V60I/
K88Q/Y93H/N97D/R98K/K125Q/K173Q/K184R/
F209I/M212R/N214D/H219D/Y221V/E238D/K252Q/
Q292K/Q321A/E333D/A345T/N369I/S377Y/T405R/
F424L/N429G/A436S/T501P/D536E;
S2K/S3R/G4V/E5G/T6R/F7A/K24Q/Q38N/K58Q/V60I/
K88Q/Y93H/N97D/R98K/K125Q/K173Q/K184R/
F209I/M212R/N214D/H219D/Y221V/E238D/K252Q/
Q292K/Q321A/E333D/A345T/N369I/S377Y/T405R/
N429G/A436S/T501P/D536E;
K24A/Q38A/K58A/V60I/K88A/Y93H/N97D/R98K/
K125A/K173A/K184R/F209I/M212R/N214D/
H219D/Y221V/E238D/K252A/D274M/Q292K/
Q321A/E333D/A345T/N369I/S377Y/T405R/N429G/
A436S/T501P/D536E;
K24A/Q38A/K58A/V60I/K88A/Y93H/N97D/R98K/
K125A/K173A/K184R/F209I/M212R/N214D/
H219D/Y221V/E238D/K252A/D274N/Q292K/
Q321A/E333D/A345T/N369I/S377Y/T405R/N429G/
A436S/T501P/D536E;
K24A/Q38A/K58A/V60I/K88A/Y93H/N97D/R98K/
K125A/K173A/K184R/F209I/M212R/N214D/
H219D/Y221V/E238D/K252A/D274S/Q292K/
Q321A/E333D/A345T/N369I/S377Y/T405R/N429G/
A436S/T501P/D536E;
K24A/Q38A/K58A/V60I/K88A/Y93H/N97D/R98K/
K125A/K173A/K184R/F209I/M212R/N214D/

H219D/Y221V/E238D/K252A/D274F/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/D274G/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/D274H/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/D274E/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/F279S/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/F279I/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/F279P/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/F279D/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/F279L/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/F279N/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/A281W/Q292K/Q321A/E333D/A345T/E350K/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/F279M/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/F279H/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/F279C/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/P281W/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/F279A/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/F279G/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/F279W/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/P281H/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/P281K/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/P281A/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/P281S/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/P281W/Y283F/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/P281A/Q282P/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/Q292K/F316L/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/E280L/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/

H219D/Y221V/E238D/K252A/P281L/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/P281Y/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/P281L/Q282P/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/Q282S/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/Q282A/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/Q282I/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/Q282R/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/Q282Y/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/Q282L/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/Q282G/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/Q282G/Q292K/Q321A/N324S/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/Q282A/Q292K/Q321A/E333D/A345T/N347S/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/Q282W/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/

H219D/Y221V/E238D/K252A/Q282P/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/Q282E/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/A284T/Q292K/Y307H/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/A284G/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/A284P/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/A284G/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/A284V/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/A284G/Q292K/D301X/Q321A/E333D/A345T/R358X/N369I/S377Y/V378X/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/A284R/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/A284D/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/A284E/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/Y283N/A284S/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/A284H/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/

H219D/Y221V/E238D/K252A/A284K/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/A284I/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/A284W/Q292K/Q321A/E333D/L342X/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/A284T/Q292K/Q321A/E333D/A345T/N369I/S377Y/T405R/N429G/A436S/T501P/D536E;

K24A/Q38A/K58A/V60I/K88A/Y93H/N97D/R98K/K125A/K173A/K184R/F209I/M212R/N214D/H219D/Y221V/E238D/K252A/A284M/Q292K/Q321A/W323R/E333D/A345T/N369I/S377Y/T405R/N429G/A436S/T501P/D536E;

K24Q/Q38N/K58Q/V60I/K88Q/Y93H/N97D/R98K/K125Q/K173Q/K184R/F209I/M212R/N214D/H219D/Y221V/E238D/K252Q/P281S/Q282S/Q292K/E311P/Q321A/E333D/A345T/N369I/S377Y/T405R/N429G/A436S/T501P/D536E;

K24Q/Q38N/K58Q/V60I/K88Q/Y93H/N97D/R98K/K125Q/K173Q/K184R/F209I/M212R/N214D/H219D/Y221V/E238D/K252Q/P281S/Q282S/Q292K/L310H/E318K/Q321A/E333D/A345T/N369I/S377Y/T405R/N429G/A436S/T501P/D536E;

K24Q/Q38N/K58Q/V60I/K88Q/Y93H/N97D/R98K/K125Q/K173Q/K184R/F209I/M212R/N214D/H219D/Y221V/E238D/K252Q/P281S/Q282S/Q292K/L310H/Q321A/E333D/A345T/N369I/S377Y/T405R/N429G/A436S/T501P/D536E;

K24Q/Q38N/K58Q/V60I/K88Q/Y93H/N97D/R98K/K125Q/K173Q/K184R/F209I/M212R/N214D/H219D/Y221V/E238D/K252Q/Q292K/E311P/Q321A/E333D/A345T/N369I/S377Y/T405R/N429G/A436S/T501P/D536E;

K24Q/Q38N/K58Q/V60I/K88Q/Y93H/N97D/R98K/K125Q/K173Q/K184R/F209I/M212R/N214D/H219D/Y221V/E238D/K252Q/Q292K/T317S/V320G/Q321A/E333D/A345T/N369I/S377Y/T405R/N429G/A436S/T501P/D536E;

K24Q/Q38N/K58Q/V60I/K88Q/Y93H/N97D/R98K/K125Q/K173Q/K184R/F209I/M212R/N214D/H219D/Y221V/E238D/K252Q/Q292K/Q321A/E333D/A345T/H360L/N369I/Q370H/A375D/S377Y/T405R/T409G/N429G/A436S/E495G/T501P/D536E;

K24Q/Q38N/K58Q/V60I/K88Q/Y93H/N97D/R98K/K125Q/K173Q/K184R/F209I/M212R/N214D/H219D/Y221V/E238D/K252Q/Q292K/Q321A/E333D/A345T/N369I/Q370H/A375D/S377Y/T405R/T409G/N429G/A436S/E495G/T501P/D536E;

S2P/S3R/G4R/E5D/T6R/F7A/K24Q/Q38N/K58Q/V60I/K88Q/Y93H/N97D/R98K/K125Q/K173Q/K184R/F209I/M212R/N214D/H219D/Y221V/E238D/K252Q/Q292K/Q321A/E333D/A345T/N369I/S377Y/T405R/N429G/A436S/T501P/D536E;

S3L/G4S/E5H/T6D/F7S/K24Q/Q38N/K58Q/V60I/K88Q/Y93H/N97D/R98K/K125Q/K173Q/K184R/F209I/M212R/N214D/H219D/Y221V/E238D/K252Q/Q292K/Q321A/E333D/A345T/N369I/S377Y/T405R/N429G/A436S/T501P/D536E;

S2T/S3R/E5I/T6L/F7K/K24Q/Q38N/K58Q/V60I/K88Q/Y93H/N97D/R98K/K125Q/K173Q/K184R/F209I/M212R/N214D/H219D/Y221V/E238D/K252Q/Q292K/Q321A/E333D/A345 T/N369I/S377Y/T405R/N429G/A436S/T501P/D536E;

S2L/S3D/G4S/E5I/T6A/F7G/K24Q/Q38N/K58Q/V60I/K88Q/Y93H/N97D/R98K/K125Q/K173Q/K184R/F209I/M212R/N214D/H219D/Y221V/E238D/K252Q/Q292K/Q321A/E333D/A345T/N369I/S377Y/T405R/N429G/A436S/T501P/D536E;

S2H/S3E/G4P/E5S/T6E/F7T/K24Q/Q38N/K58Q/V60I/K88Q/Y93H/N97D/R98K/K125Q/K173Q/K184R/F209I/M212R/N214D/H219D/Y221V/E238D/K252Q/Q292K/Q321A/E333D/A345T/N369I/S377Y/T405R/N429G/A436S/T501P/D536E;

S2L/S3G/G4V/E5S/T6E/F7Q/K24Q/Q38N/K58Q/V60I/K88Q/Y93H/N97D/R98K/K125Q/K173Q/K184R/F209I/M212R/N214D/H219D/Y221V/E238D/K252Q/Q292K/Q321A/E333D/A345T/N369I/S377Y/T405R/N429G/A436S/T501P/D536E;

S2R/S3V/G4A/E5P/T6K/K24Q/Q38N/K58Q/V60I/K88Q/Y93H/N97D/R98K/K125Q/K173Q/K184R/F209I/M212R/N214D/H219D/Y221V/E238D/K252Q/Q292K/Q321A/E333D/A345T/N369I/S377Y/T405R/N429G/A436S/T501P/D536E;

S2R/S3A/G4E/E5L/T6S/F7L/K24Q/Q38N/K58Q/V60I/K88Q/Y93H/N97D/R98K/K125Q/K173Q/K184R/F209I/M212R/N214D/H219D/Y221V/E238D/K252Q/Q292K/Q321A/E333D/A345T/N369I/S377Y/T405R/N429G/A436S/T501P/D536E;

S2Q/G4I/E5T/T6D/F7K/K24Q/Q38N/K58Q/V60I/K88Q/Y93H/N97D/R98K/K125Q/K173Q/K184R/F209I/M212R/N214D/H219D/Y221V/E238D/K252Q/Q292K/Q321A/E333D/A345T/N369I/S377Y/T405R/N429G/A436S/T501P/D536E;

S2R/S3V/G4I/E5D/T6G/F7G/K24Q/Q38N/K58Q/V60I/K88Q/Y93H/N97D/R98K/K125Q/K173Q/K184R/F209I/M212R/N214D/H219D/Y221V/E238D/K252Q/Q292K/Q321A/E333D/A345T/N369I/S377Y/T405R/N429G/A436S/T501P/D536E;

K24Q/Q38N/K58Q/V60I/K88Q/Y93H/N97D/R98K/L106A/K125Q/K173Q/K184R/F209I/M212R/N214D/H219D/Y221V/E238D/K252Q/Q292K/Q321A/E333D/A345T/N369I/S377Y/T405R/N429G/A436S/T501P/D536E;

K24Q/Q38N/K58Q/V60I/K88Q/Y93H/N97D/R98K/L106S/K125Q/K173Q/K184R/F209I/M212R/N214D/H219D/Y221V/E238D/K252Q/Q292K/Q321A/E333D/A345T/N369I/S377Y/T405R/N429G/A436S/T501P/D536E;

K24Q/Q38N/K58Q/V60I/K88Q/Y93H/N97D/R98K/L106K/K125Q/K173Q/K184R/F209I/M212R/N214D/H219D/Y221V/E238D/K252Q/Q292K/Q321A/E333D/A345T/N369I/S377Y/T405R/N429G/A436S/T501P/D536E;

K24Q/Q38N/T53L/D54A/A55P/E56P/D57P/K58R/V60I/K88Q/Y93H/N97D/R98K/K125Q/K173Q/K184R/F209I/M212R/N214D/H219D/Y221V/E238D/K252Q/Q292K/Q321A/E333D/A345T/N369I/S377Y/T405R/N429G/A436S/T501P/D536E;

K24Q/Q38N/K58Q/V60I/K88Q/Y93H/N97D/R98K/K125Q/M153N/K173Q/K184R/F209I/M212R/N214D/H219D/Y221V/E238D/K252Q/Q292K/Q321A/E333D/A345T/N369I/S377Y/T405R/N429G/A436S/K474T/T501P/D536E;

K24Q/Q38N/K58Q/V60I/K88Q/Y93H/N97D/R98K/K125Q/K173Q/K184R/F209I/M212R/I213S/N214D/H219D/Y221V/E238D/K252Q/Q292K/Q321A/E333D/A345T/N369I/S377Y/T405R/N429G/A436S/T501P/D536E;
K24Q/Q38N/K58Q/V60I/K88Q/Y93H/N97D/R98K/K125Q/K173Q/K184R/F209I/M212R/N214D/H219A/Y221V/E238D/K252Q/Q292K/Q321A/E333D/A345T/N369I/S377Y/T405R/N429G/A436S/T501P/D536E;
K24Q/Q38N/K58Q/V60I/K88Q/Y93H/N97D/R98K/K125Q/K173Q/K184R/Q188R/I189V/P202S/F209I/M212R/N214D/H219D/Y221V/E238D/K252Q/Q292K/Q321A/E333D/A345T/N369I/S377Y/T405R/N429G/A436S/T501P/D536E;
K24Q/Q38N/K58Q/V60I/K88Q/Y93H/N97D/R98K/K125Q/M153N/K173Q/K184R/F209I/M212R/N214D/H219D/Y221V/E238D/K252Q/Q292K/Q321A/E333D/A345T/N369I/S377Y/T405R/N429G/A436S/K474T/T501P/D536E;
K24Q/Q38N/K58Q/V60I/K88Q/Y93H/N97D/R98K/K125Q/H159R/K173Q/K184R/F209I/M212R/N214D/H219D/Y221V/E238D/K252Q/Q292K/Q321A/E333D/A345T/N369I/S377Y/T405R/N429G/A436S/T501P/D536E;
K24Q/Q38N/K58Q/V60I/K88Q/Y93H/N97D/R98K/K125Q/H159K/K173Q/K184R/F209I/M212R/N214D/H219D/Y221V/E238D/K252Q/Q292K/Q321A/E333D/A345T/N369I/S377Y/T405R/N429G/A436S/T501P/D536E;
K24Q/Q38N/K58Q/V60I/K88Q/Y93H/N97D/R98K/K125 Q/K173Q/K184R/I189P/F209I/M212R/N214D/H219D/Y221V/E238D/K252Q/Q292K/Q321A/E333D/A345T/N369I/S377Y/T405R/N429G/A436S/T501P/D536E;
K24Q/Q38N/T53L/D54P/A55R/E56F/D57S/K58Q/V60I/K88Q/Y93H/N97D/R98K/K125Q/K173Q/K184R/F209I/M212R/N214D/H219D/Y221V/E238D/K252QQ292K/Q321A/E333D/A345T/N369I/S377Y/T405R/N429G/A436S/T501P/D536E;
K24Q/Q38N/D54A/A55V/E56A/D57Q/K58P/V60I/K88Q/Y93H/N97D/R98K/L106F/K125Q/K173Q/K184R/F209I/M212R/N214D/H219D/Y221V/L238D/K252Q/Q292K/Q321A/L333D/A345T/N369I/S377Y/T405R/N429G/A436S/T501P/D536E;
K24Q/Q38N/T53R/D54A/A55Q/E56T/D57A/K58R/V60/K88Q/Y93H/N97D/R98K/K125Q/K173Q/K184R/F209I/M212R/N214D/H219D/Y221V/L238D/K252Q/Q292K/Q321A/L333D/A345T/N369I/S377Y/T405R/N429G/A436S/T501P/D536E;
K24Q/Q38N/T53R/D54C/A55V/L56Q/D57P/K58L/V60I/K88Q/Y93H/N97D/R98K/K125Q/K173Q/K184R/F209I/M212R/N214D/H219D/Y221V/E238D/K252Q/Q292K/Q321A/E333D/A345T/N369I/S377Y/T405R/N429G/A436S/T501P/D536E;
K24Q/Q38N/K58Q/V60I/K88Q/Y93H/N97D/R98K/K125Q/R132G/K173Q/K184R/F209I/M212R/N214D/H219D/Y221V/E238D/K252Q/Q292K/Q321A/E333D/A345T/N369I/S377Y/T405R/N429G/A436S/T501P/D536E;
K24Q/Q38N/K58Q/V60I/K88Q/Y93H/N97D/R98K/K125Q/H159Q/K173Q/K184R/F209I/M212R/N214D/H219D/Y221V/E238D/K252Q/Q292K/Q321A/L333D/A345T/N369I/S377Y/T405R/N429G/A436S/T501P/D536E;
K24Q/Q38N/K58Q/V60I/K88Q/Y93H/N97D/R98K/K125Q/M153G/K173Q/K184R/F209I/M212R/N214D/H219D/Y221V/E238D/K252Q/Q292K/Q321A/L333D/A345T/N369I/S377Y/T405R/N429G/A436S/T501P/D536E;
K24Q/Q38N/K58Q/V60I/K88Q/Y93H/N97D/R98K/K125Q/K173Q/K184R/F209I/M212R/N214D/H219D/Y221V/E238D/K252Q/Q292K/Q321A/E333D/A345T/N369I/S377Y/I397V/T405R/N429G/A436S/T501P/D536E;
K24Q/Q38N/K58Q/V60I/K88Q/Y93H/N97D/R98K/K125Q/K173Q/K184R/I189A/F209I/M212R/N214D/H219D/Y221V/E238D/K252Q/Q292K/Q321A/E333D/A345T/N369I/S377Y/T405R/N429G/A436S/T501P/D536E;
K24Q/Q38N/K58Q/V60I/K88Q/Y93H/N97D/R98K/K125Q/K173Q/K184R/F209I/M212R/N214D/H219D/Y221V/E238D/K252Q/Q292K/L310H/E311P/Q321A/E333D/A345T/N369I/S377Y/T405R/N429G/A436S/T501P/D536E;
K24Q/Q38N/K58Q/V60I/K88Q/Y93H/N97D/R98K/K125Q/K173Q/K184R/F209I/M212N/I213Y/N214L/S215R/T216R/S217I/D218P/H219A/L220D/Y221S/E238D/K252Q/P281S/Q 292K/L313C/S314T/L315M/T317S/Q321A/E333D/K336R/L337I/A345T/G357R/N369I/S377Y/T405R/N429G/A436S/T501P/D536E;
K24Q/Q38N/K58Q/V60I/K88Q/Y93H/N97D/R98K/Q113R/K125Q/K173Q/K184R/F209I/M212D/I213Y/N214E/S215H/T216Q/D218I/H219L/L220V/Y221Q/E238D/K252Q/P281S/Q 292K/L313C/S314T/L315M/T317S/Q321A/E333D/K336R/L337I/A345T/G357R/N369I/S377Y/T405R/N429G/A436S/T501P/D536E;
K24Q/Q38N/K58Q/V60I/K88Q/Y93H/N97D/R98K/K125Q/K173Q/K184R/F209I/M212S/I213L/N214E/S215P/T216P/S217F/D218M/L220P/Y221C/E238D/K252Q/Q292K/L313C/S314T/L315M/T317S/Q321A/E333D/K336R/L337I/A345T/G357R/N369I/S377Y/T405R/N429G/A436S/T501P/D536E;
K24Q/Q38N/K58Q/V60I/K88Q/Y93H/N97D/R98K/K125Q/K173Q/K184R/F209I/M212A/N214Y/S215A/T216R/S217T/D218G/H219R/L220M/Y221N/E238D/K252Q/Q292K/L313C/S314T/L315M/T317S/Q321A/E333D/K336R/L337I/A345T/G357R/N369I/S377Y/T405R/N429G/A436S/T501P/D536E;
K24Q/Q38N/K58Q/V60I/K88Q/Y93H/N97D/R98K/K125Q/K173Q/K184R/F209I/M212N/I213M/N214S/T216Y/S217R/D218G/H219C/L220S/Y221V/E238D/K252Q/P281S/Q292K/L313C/S314T/L315M/T317S/A319T/Q321A/E333D/K336R/L337I/A345T/N369I/S377Y/T405R/N429G/A436S/T501P/D536E;
K24Q/Q38N/K58Q/V60I/K88Q/Y93H/N97D/R98K/K125Q/K173Q/K184R/F209I/M212D/I213A/S215G/T216E/S217K/D218V/H219L/L220S/Y221F/E238D/K252Q/P281S/Q292K/L313C/S314T/L315M/T317S/Q321A/E333D/K336R/L337I/A345T/G357R/N369I/S377Y/T405R/N429G/A436S/T501P/D536E;
K24Q/Q38N/K58Q/V60I/K88Q/Y93H/N97D/R98K/K125Q/K173Q/K184R/F209I/M212S/I213R/N214S/S215K/T216P/S217F/D218C/H219W/L220T/Y221S/E238D/K252Q/Q292K/Q321A/E333D/A345T/N369I/S377Y/T405R/N429G/A436S/T501P/D536E; and
K24Q/Q38N/K58Q/V60I/K88Q/Y93H/N97D/R98K/K125Q/K173Q/K184R/F209H/M212R/N214D/H219D/Y221V/E238D/K252Q/P281S/Q292K/L313C/S314T/L315M/T317S/Q321A/E333D/K336R/L337I/A345T/G357R/N369I/S377Y/T405R/N429G/A436S/T501P/D536E, each with number relative to positions set forth in SEQ ID NO:2.

10. The nucleic acid molecule of claim 1, comprising the sequence of nucleic acids set forth in any of SEQ ID NOS: 128-202, 204-288, 693-701, 704-712, 716-722, 754-775 and 800; or a sequence of nucleic acids having at least 95% sequence identity to the sequence of nucleic acids set forth in any of SEQ ID NOS: 128-202, 204-288, 693-701, 704-712, 716-722, 754-775 and 800; and degenerates thereof.

11. The nucleic acid molecule of claim 1, wherein the encoded modified valencene synthase comprises the sequence of amino acids set forth in any of SEQ ID NO: 3-66, 68-127, 723-731, 734-742, 746-751, 810-832 and 857, or a sequence of amino acids that has at least 95% sequence identity to the sequence of amino acids set forth in any of SEQ ID NO: 3-66, 68-127, 723-731, 734-742, 746-751, 810-832 and 857.

12. The nucleic acid molecule of claim 1, comprising the sequence of nucleic acids set forth in any of SEQ ID NO: 203, 352-353, 702, 703, 713-715, 776-799, 801-809, 891-894, 896, 945, 947, 949, 951, 953, 955, 957, 959, 961, 963, 965, 967, 969, 971, 973, 975, 977, 979, 981, 983, 985, 987, 989, 991, 993, 995, 997 and 999; a sequence of nucleic acids that has at least 95% sequence identity to the sequence of nucleic acids set forth in any of SEQ ID NO: 203, 352-353, 702, 703, 713-715, 776-799, 801-809, 891-894, 896, 945, 947, 949, 951, 953, 955, 957, 959, 961, 963, 965, 967, 969, 971, 973, 975, 977, 979, 981, 983, 985, 987, 989, 991, 993, 995, 997 and 999; or degenerates thereof.

13. The nucleic acid molecule of claim 1, wherein the modified valencene synthase comprises:

a) the sequence of amino acids set forth in any of SEQ ID NOS: 67, 350, 351,732-733, 743-745, 833-856, 858-866, 887-890, 895, 944, 946, 948, 950, 952, 954, 956, 958, 960, 962, 964, 966, 968, 970, 972, 974, 976, 978, 980, 982, 984, 986, 988, 990, 992, 994, 996 and 998; or b) a sequence of amino acids that has at least 95% sequence identity to the sequence of amino acids set forth in any of SEQ ID NOS: 67, 350, 351,732-733, 743-745, 833-856, 858-866, 887-890, 895, 944, 946, 948, 950, 952, 954, 956, 958, 960, 962, 964, 966, 968, 970, 972, 974, 976, 978, 980, 982, 984, 986, 988, 990, 992, 994, 996 and 998.

14. The nucleic acid molecule of claim 1, wherein the modified valencene synthase polypeptide prior to modification comprises an unmodified valencene synthase polypeptide having the sequence of amino acids set forth in any of SEQ ID NOS: 2, 4, 289-291, 346, 347, 752, 882 and 883.

15. The nucleic acid molecules of claim 1, wherein the modified valencene synthase polypeptide produces a decreased percentage of a terpene produce from the valencene synthase set forth in SEQ ID NO: 2.

16. The nucleic acid molecule of claim 15, wherein the terpene product other than valencene is selected from among β-selinene, τ-selinene, eremophilone, 7-epi-α-selinene, germacrene A and β-elemene.

17. The nucleic acid molecule of claim 15, wherein the encoded modified valencene polypeptide further comprises amino acid replacements at positions corresponding to positions 281, 313, 314, 315, 317, 336, 337, 347 or 357 by CVS numbering relative to the valencene synthase polypeptide set forth in SEQ ID NO:2.

18. The nucleic acid molecule of claim 17, wherein the encoded modified valencene synthase polypeptide comprises amino acid replacements at positions corresponding to replacements P281S, P281H, P281K, P281A, P281W, P281L, P281Y, L313C, S314T, L315M, T317S, K336R, L337I, N347L or G357R.

19. A vector, comprising the nucleic acid molecule of claim 1.

20. The vector of claim 19, wherein the vector is a prokaryotic vector, a viral vector, or an eukaryotic vector.

21. The vector of claim 19, wherein the vector is a yeast vector.

22. An isolated cell, comprising the vector of claim 19.

23. The cell of claim 22 that is a prokaryotic cell or an eukaryotic cell.

24. The cell of claim 22, that is selected from among a bacteria, yeast, insect, plant or mammalian cell.

25. A cell, comprising the vector of claim 19, wherein the cell is a *Saccharomyces cerevisiae* cell or an *Escherichia coli* cell.

26. The cell of claim 22, wherein said cell produces farnesyl diphosphate (FPP) either natively or is modified to produce FPP compared to an unmodified cell.

27. A modified valencene synthase produced by the cell of claim 22.

28. A transgenic plant, comprising the vector of claim 19.

29. The transgenic plant of claim 28, that is a Citrus plant or a tobacco plant.

30. A method for producing a modified valencene synthase polypeptide, comprising:

introducing the nucleic acid molecule of claim 1 into a cell;

culturing the cell under conditions suitable for the expression of the modified valencene synthase polypeptide encoded by the nucleic acid; and, optionally isolating the modified valencene synthase polypeptide.

31. The method of claim 30, wherein:

the cell produces an acyclic pyrophosphate terpene precursor;

the modified valencene synthase polypeptide encoded by the nucleic acid molecule is expressed; and the modified valencene synthase polypeptide catalyzes the formation of valencene from the acyclic pyrophosphate terpene precursor.

32. The method of claim 31, wherein the acyclic pyrophosphate terpene precursor is selected from among farnesyl diphosphate (FPP), geranyl diphosphate (GPP) and geranylgeranyl diphosphate (GGPP).

33. The method of claim 30, wherein the cell is selected from among a bacteria, yeast, insect, plant or mammalian cell.

34. The method of claim 30, wherein the cell is a yeast cell and is a *Saccharomyces cerevisiae* cell.

35. The method of claim 30, wherein the cell is modified to produce more FPP compared to an unmodified cell.

36. The method of claim 31, wherein the amount of valencene produced is greater than the amount of valencene produced under the same conditions when the same host cell type is transformed with the nucleic acid encoding the valencene synthase set forth in SEQ ID NO:2.

37. The method of claim 31, further comprising isolating the valencene; optionally, further comprising oxidizing the valencene to produce nootkatone; and optionally further comprising isolating the nootkatone.

38. A method of improving valencene production, comprising:

introducing the nucleic acid molecule of claim 15 into the host cell that produces an acyclic pyrophosphate terpene precursor, wherein the encoded valencene synthase polypeptide catalyzes formation of valencene from the acyclic pyrophosphate terpene precursor as the primary product;

culturing the cells under conditions sufficient for expression of the encoded valencene synthase polypeptide for catalysis of the precursor to produce valencene; and recovering valencene from the cell medium.

39. The method of claim 38, wherein recovery of valencene is effected by extraction with an organic solvent.

40. The method of claim 38, wherein the recovered valencene is greater than 68% valencene by weight solution.

41. The method of any claim 38, wherein the recovered valencene is about greater than or greater than 70%, 71%, 72%, 73%, 75%, 75%, 76%, 77%, 78%, 78%, 79%, 80% valencene by weight solution.

42. The method of claim 38, wherein the acyclic pyrophosphate terpene precursor is selected from among farnesyl diphosphate (FPP), geranyl diphosphate (GPP) and geranyl-geranyl diphosphate (GGPP).

43. The method of claim 38, wherein the acyclic pyrophosphate terpene precursor is FPP.

44. The method of claim 38, wherein the cell is selected from among a bacteria, yeast, insect, plant or mammalian cell.

45. The method of claim 38, wherein the cell is a yeast cell and is a *Saccharomyces cerevisiae* cell.

46. The method of claim 38, further comprising oxidizing the valencene to produce nootkatone.

47. The method of claim 38, further comprising isolating the nootkatone.

48. The nucleic acid molecule of claim 1 that is complementary DNA (cDNA).

49. The nucleic acid molecule of claim 1, wherein the encoded modified valencene synthase polypeptide comprises amino acid replacements corresponding to A345T and T405R by CVS numbering with reference to positions set forth in SEQ ID NO:2, and corresponding amino acids are identified by alignment with the polypeptide of SEQ ID NO:2.

50. A method for producing valencene, comprising:

contacting an acyclic pyrophosphate terpene precursor with the modified valencene synthase polypeptide encoded by the nucleic acid molecule of claim 1 under conditions suitable for the formation of valencene from the acyclic pyrophosphate terpene precursor; and optionally, isolating the valencene.

51. The method of claim 50, wherein the step of contacting the acyclic pyrophosphate terpene precursor with the modified valencene synthase polypeptide is effected in vitro or in vivo.

52. The method of claim 50, comprising isolating the valencene and oxidizing the valencene to produce nootkatone.

53. The nucleic acid molecule of claim 1, wherein the encoded modified valencene synthase comprises the sequence of amino acids set forth in SEQ ID NO: 3 or a catalytically active portion thereof.

54. The nucleic acid molecule of claim 1, wherein the encoded modified valencene synthase consists of the sequence of amino acids set forth in SEQ ID NO: 3.

55. The nucleic acid molecule of claim 2, wherein the modified valencene polypeptide comprises a sequence of amino acids that has at least 82% sequence identity to the valencene synthase set forth in SEQ ID NO:2.

56. The nucleic acid molecule of claim 2, wherein the modified valencene synthase polypeptide comprises a sequence of amino acids that has less than 95% sequence identity and more than 85% sequence identity to the valencene synthase whose sequence is set forth in SEQ ID NO:2.

57. The nucleic acid molecule of claim 2, wherein the encoded modified valencene synthase further polypeptide comprises at least one modification selected from among amino acid replacements corresponding to M1T, S2R, S2K, S2E, S2Q, S2P, S2T, S2L, S2H, S2A, S2V, S3D, S3R, S3G, S3I, S3E, S3V, S3A, S3T, S3L, S3M, S3N, G4K, G4V, G4N, G4I, G4R, G4S, G4P, G4A, G4E, G4F, G4C, G4T, G4L, G4Q, E5A, E5G, E5S, E5T, E5D, E5H, E5I, E5P, E5L, E5N, E5V, T6R, T6V, T6D, T6L, T6A, T6E, T6K, T6S, T6G, T6C, T6M, T6Y, F7C, F7A, F7Q, F7K, F7S, F7G, F7T, F7L, F7R, F7P, F7N, T10V, A11T, D12N, S16N, L17I, R19K, R19P, R19G, N20D, H21Q, L23I, L23S, K24A, K24Q, K24Y, K24T, G25Y, A26T, S27P, D28G, D28E, F29D, D33T, H34R, T35A, A36C, T37K, Q38V, Q38A, Q38N, Q38E, R40Q, H41I, R50G, T53L, T53R, D54A, D54P, D54C, A55T, A55P, A55R, A55V, A55Q, E56G, E56P, E56F, E56A, E56T, E56Q, D57R, D57P, D57S, D57Q, D57A, K58Q, K58R, K58P, K58E, K58A, V60I, V60G, K62R, V69I, F78L, I82V, A85M, I86L, Q87D, K88Q, K88A, K88H, L89I, C90Y, P91N, I92Y, I92N, I92S, Y93H, Y93F, Y93F, I94E, I94H, D95A, S96H, S96C, N97D, N97E, R98K, R98Y, R98D, A99N, A99M, H102Y, L106A, L106S, L106K, L106F, L111S, Q113R, I166Y, K117T, V122I, E124N, K125A, K125Q, K127T, D129E, E130R, R132G, S135E, S136A, N139S, Q142R, S146G, Y152H, M153N, M153G, H159Q, H159K, H159R, E163D, K173E, K173Q, K173A, Q178A, D179P, V181L, T182K, P183S, K184R, K184P, Q188R, I189A, I189V, I189P, T200Q, P202S, F209I, F209H, F209E, F209L, F209T, M210T, M212R, M212D, M212N, M212S, M212A, M212Y, M212K, M212F, M212H, M212Q, M212I, M212S, M212V, I213Y, I213M, I213A, I213R, I213S, I213L, I213F, I213S, I213P, I213Q, I213N, I213K, I213V, I213Y, N214D, N214E, N214S, N214L, N214Y, N214V, N214P, N214H, N214C, N214A, N214T, N214R, N214Y, N214Q, S215H, S215G, S215K, S215R, S215P, S215A, S215N, S215T, S215L, S215V, S215Q, S215D, T216Q, T216Y, T216E, T216P, T216R, T216C, T216V, T216K, T216D, T216A, T216S, T216K, S217R, S217K, S217F, S217I, S217T, S217G, S217Y, S217N, S217H, S217E, S217F, S217C, S217E, S217D, D218I, D218G, D218V, D218C, D218P, D218M, D218R, D218L, D218S, D218A, D218Y, D218K, D218E, H219D, H219A, H219L, H219C, H219W, H219R, H219S, H219F, H219E, H219G, H219Q, H219A, L220V, L220S, L220T, L220P, L220M, L220A, L220H, L220E, L220G, L220D, L220F, Y221C, Y221V, Y221Q, Y221F, Y221S, Y221N, Y221T, Y221P, Y221L, Y221K, Y221W, Y221E, Y221V, Y221H, N227S, E238D, K252A, K252Q, T257A, D274M, D274N, D274S, D274F, D274G, D274H, D274E, F279S, F279I, F279P, F279D, F279L, F279N, F279M, F279H, F279C, F279A, F279G, F279W, E280L, P281S, P281H, P281K, P281A, P281W, P281L, P281Y, Q282L, Q282S, Q282A, Q282I, Q282R, Q282Y, Q282G, Q282W, Q282P, Q282E, Y283F, Y283N, A284T, A284G, A284P, A284V, A284R, A284D, A284E, A284S, A284H, A284K, A284I, A284W, A284M, Q292K, I299Y, Y307H, L310H, E311P, E311T, L313C, S314A, S314T, L315M, F316L, T317S, E318K, A319T, V320D, V320G, V320S, Q321A, W323R, N324S, I325T, E326K, E333D, K336R, L337I, L343V, A345V, A345T, N347L, N347S, E348A, E348S, E350K, G357R, H360L, H360A, C361R, V362A, E367G, N369I, Q370D, Q370H, Q370G, K371G, A375D, S377Y, Y387C, I397V, L399S, T405R, T409G, N410S, F424L, N429S, N429G, A436S, V439L, Q448L, C465S, K468Q, S473Y, K474T, E484D, I492V, E495G, K499E, P500L, T501P, P506S, D536E and A539V by citrus valencene synthase (CVS) numbering with reference to positions set forth in SEQ ID NO:2, and corresponding amino acids are identified by alignment with the polypeptide of SEQ ID NO:2.

58. The nucleic acid molecule of claim 2, wherein the modified valencene synthase polypeptides comprises amino acid replacements selected from among replacements corresponding to N214D/S473Y; T405R; A345V/D536E; Y221C; E238D; F209I; N97D; E333D/N369I; N214D/T405R; N214D/A345V/T405R/D536E; R98K/N214D/N227S/T405R; V60I/N214D/A345T/T405R; N214D/T405R/N429S; N214D/Q292K/T405R; V60G/N214D/T405R; V60I/N214D/A345T/T405R/N429S; V60I/M212R/N214D/Y221V/A345T/T405R/N429G, by CVS numbering relative to positions set forth in SEQ ID NO:2.

59. The nucleic acid molecule of claim 2 that is complementary DNA (cDNA).

60. The nucleic acid molecule of claim 2, wherein the encoded modified valencene synthase polypeptide comprises amino acid replacements selected from among V60I, V60G, N97D, F209I, F209H, F209E, F209L, F209T, M212R, M212D, M212N, M212S, M212A, M212Y, M212K, M212F, M212H, M212Q, N214D, N214E, N214S, N214L, N214Y, N214V, N214P, N214H, N214C, N214A, N214T, N214R, Y221C, Y221V, Y221Q, Y221F, Y221S, Y221N, Y221T, Y221P, Y221L, Y221K, Y221W, Y221E, Y221V, E238D, Q292K, E333D, A345V, A345T, N369I, T405R, N429S, N429G, S473Y, and/or D536E by CVS numbering with reference to positions set forth in SEQ ID NO:2.

61. The nucleic acid molecule of claim 2, wherein the encoded modified valencene synthase polypeptide comprises amino acid replacements corresponding to A345T and T405R by CVS numbering with reference to positions set forth in SEQ ID NO:2, and corresponding amino acids are identified by alignment with the polypeptide of SEQ ID NO:2.

62. The nucleic acid molecule of claim 2, wherein the modified valencene synthase polypeptide comprises a sequence of amino acids that has at least 85% sequence identity to the valencene synthase set forth in SEQ ID NO:2.

* * * * *